United States Patent 11,549,145 (METHODS AND COMPOSITIONS FOR INHIBITING AND TREATING NEUROLOGICAL CONDITIONS) - sequence listing, part 30

SEQ ID NO: 362 - DNA, 575291 bp, Homo sapiens
aacattttattttgcttttattttttctttttgaaatacaaaatgtgcacattgagtttacacaaacacgtgatggcaaatttcagtgtacatgtattgtactactcttaatttctacactggtgatagcagggcagctttcaacatcctatctctacaccagaatagatacctgatttattgttgcaaagacagttgcaaatttcctccttctgtagcctcttggtctttgtgatatttctacaaaacagggacgatgtgtgtggctttagtaatgtggcaactttacagttttggctaagatgattaaaaataatctgaattatgatgagctaaatcatactgtaatctggattagttgttgagcacttattttctactaaatcttggtagtagttgtcaatgtaatggaaccactggtgctttcaaagtgaattttgcttgctaattttgcttgctgtttgttcttagtagacagtggggtagtcaaggtttctttctttgtccctgaatggcttgtaatataaataaacatgctgtaaggaagtcaggggaaagaggacagatttggcctttaatgctgttaggattacttgttattaagcattactatatactggaggatagatatcctgaccctttgcatatgtctgtaaacatccttgttttgtttgatgccttcttcaacttccacttaatgattgatactaatgattgatacaatagaaaacagcctgtaagaaagattgaacaaatccaaaattattatataggccttggctgtaacatattatggaaaattaaatgcttattaaaataagttttattaggcatatgctgatatctgataataaactaatttttaaatgtttaataatttttaaatgtttaaaaatgccagataaaactaatttctaacagaaggtgggaaggccatagaaactggaactatgtgtttttttaattgttgtaatcttgtttccttaaagtatataaatggaatttaaatggaattacagcattcaaacatgaaaattaatttaatttctggaaattaaatgcagatgtcactatattagaaaaccattcaaaatcctaggactgaatacatacaaatgagtagcaaaaaacactgatattttaaaatcactgatatgtgaaagcctcaataatcccatggctaaggaaccaataaaactatatgccagattctattacttttgaatattcacagagtatgaaatgagttagaccatcccctgaactcagtggcattatgaaaaggatgcaaatttataactgaaagctcaaatcttttggggattgctttatattaaaacaaagcttgtttgcataatatgcttcagtgtcaagctgagcaatctatgctaaaagtggtagctccaactttaagggtggtagaatagttcacatttgtctgttggattcaggatctatttgacaagttaaatcacattttcaaagagctgcatggagcgcattatgttttcatcctgtaagggagaaacacagagcgattaaattcagcatatctgcaaggaaaagtacactattttgcccctgagtattgcctcctcccatcaaccacctcaaccacctatgccaaaagctcaaatattaagtgtttgcaaatgtaaatgccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctgggattacagttgtgagctactgtaccaggccttaacaatttttaactgtggttctgcccacacatcaagtcaaataattctaagtaagctaacactggtttctttgataacaggctactacctggagttctcttcagagaaaattttccactgtttattttttgtgactgaagaccattagtgagttcagtcaaagagccatttcttgtccacatacactaaaacaatgacttttctcttagaaatcagatagaagcttggcctgttgtgatgccatacttggctatctaggaattctaatgctgtggagatatgatagataatatatgagtgatgctaagttttggcaaagagcaattcaaatctcatgtatgttttatcctccatgaatactctctaaggaatttgggaatcaacacagtacatgtacaacttttgtatccccagggtttcctccatagcctgactcagtgggcactctaaatgttgattatgtaattggtgcttgttttcagagtggtaggcttatgctgcatgttgtagaagtggtaaacttaggcatatgatctctatatttcgcccagttcatggtagctagctgctaatactcagtttagctgttatgatagctgaattgatagttattacactttcattacttactttttggcagctttcaatgaactcatctatggtaacaaccccatctttatttttgtccattttctgttcaggaagaaaacaaaaattgtatttagacttatcccttaataccctcacacctggaccaaatgagctgaagctgataaaaagaaaacctagctgcttatttatttcacgtggaggaactgtttcagagcaggaaccagcagttttttagagataaaaatgatagggccaaatgcttctggcttttcccttttcaatataatgtggtgaagatgtagagtcactctgtcctaggtaaaatcccaccttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagtctaatttttgccttaccactttcattcttatgagagtaaaaataatctctaataacttaaacatttagatttattgttgcacatttgtttcacgtgaaagatctctcaattaggttaatacagagcgaatatatatttacttttaagagtattcaattataaatgatagagtaatttgtaaacaggtgaaaccttttaagatgttttaagcatagataagtagcaagtagtttgttagacacaggcagaattcttgagatgtgttaaacacagaggtaagaattgaagaacaagagatatttaaggtatcctaagtatctgggtaataaatattcatgatataaaaatatacaagaagcactatttaggatatgctccatatacatgaacacaatagccataaggtcttaatttggcacccactagtgatacctattctggccccaggtgtcctctgtgcaagaaacacaaatgaaacccattactacttatcaggctatactcgtgacctggcacacttgcacctgtgtctctccagtagcgcaagttcatgtcatttgctgttggccctgggcaccttttgtctgtggggcctcttgctcaaaactcaattctggggaagtctcgtgaggcaaagagagacaggacataggcacactgagaatgcccaggatttagggagtggtctttcaaccccatttgcagcctgtcctgcgtggttaacttactccatccctttctttacttctcgctgtgttttaaattggtttaataaactgtgtaatacgagtatcttaatttggtctgtgaaccttgtttcctggatagtctgcctcaacgtgcatttggagaccccaccattgcgtcaggtcattccacaatccccatgattgtaaaatttcatttccttatggatcacatgctgtggggaaaagaaaggcttcaggctaaatgttgaaacatgggttggatacattttctttctatctgattccaaccatgatctttattccattcacagtatttattaagatgccagcaggaaacaagggtgtaatctttatgtgttatatatttactttggagcttcaccataaactacttctatcccaagtttttaattgtacatctttcttccactacataaaatattttggaatttcctcaaaaaaacttttcaaattaataattgcaattaatattttaaagttaagaaatgaaaatggtccaaattactgtgatgttggtgaggcatcccttacctctttagtgatgtagccatctttatttatgtcatacagattaaatgcccaattgagtttttcttgtactgtcccccggagcaaaatggaaagacctttgatgaaatcctgaaaagaaataaaaattcaattttatatgacatttttaaaaaaacaaaaacaaaaaaaacaaatgatgtaagtaagggctacaaccctctggatcttgaacatttagcaaaatgattgatgtgttattggttgtctagttttcagacttctctgtgggcataaatcactccttagtcttaacattttcatattctaattggaaactgagttaaatcaatggtcatactggaaattgtaccagtgcgtacccacacagctagaggcttgagtataagtggtattggctttccactgcaagtgcacatgatttactaaaagaatctaataatagttttttcaaaaaaatacaagtgcacacataacacacttcaatgaaaaaccgtttgctaataagaaatgtggctgtccataaaagataaaccaattgtggtctttaattagaaatccagttataatttacatgtggacagtgggtaagagcatggaactggaaaggacagactgcctggattcaccctccagctatattactggatggctttgtgtcttcaggcaacttaacatccctttgcctcaattttcgtatctgtaaaatggagctaataatagtatctacctcttcacaattttatgaggattaaaaaagaggctgcttataacagtccttggcaatgacattggctatgtaagtttttgttaagtaaatggagccctcagtttgtatcctggttagattgcattgcagactggccagattaacttgattaaattcatttagtgtttttttttttgtttttttttttttttttgagatggaatctcgcactgttgcccaggctggagtgcagtggcacaatcttggctcactgcaacttccacctcccacctcccaggttcaagccattcttctgcctcagcctcccgagtagctgggactacaggcacccgccaccatgcctgactaatttttgtatttttggtagagatggggtttcaccatgttggccaggttggtgtcgaactcctgaccttgtgatctgcccaccgccgcctctcaaagtgctgggattacaggcgtgagccaccacgcctggccagatttcttgttgttatgtacagcagggttaacgttacaatgtgctgtattcagtttataatccacttttaggtaggaatgaaagcagaggggaaatccaaaagtcttctgggtgaatttgcattatatctccctttctcacattccttccttttatagctgtatttctatctgaatttctcaaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataattgtcaaattcatattgcaagggaccctgaatagcccagtcaattttaagaaagaaaaacaaacttggaggactcacactgcccaatatcaaaacttagtacaaagttacattaatcaaaacagtgtggtactggcataaagacagatatatagaacagtagaatagaattgagtctagatataaaccagctgtctgtggccaattgattttcgataatggtgccaagaccattcaatagctatggaaagaataatctcaatatatggtgctgtggcaactggatcaccatacttagtttgcttcccattggcatgaagggtagaatgtcaagtgagagaaaaacaagattccagagaaagccacaaggaattccaatatttggcaggtacagagaggagaagctggcaaagcatcttgaaaagaagttgctaaagaagtgagtcaggagaacagagcatttccctaggaaaggattgttcattttgctccaaggttggaaaaatgttcactggaccagcaacatggaggtcaccagcaagtgatagggaacggtccagtggagtaggagtgaagagtaatttttaatgaggagcactttgaatactgaagagaagaatctaaaaagagtaagagtcagaaatgggctgtgctcttgagaaggtggggaggatccagaacatgggtagatgggccgatctgagaagggagttgatacatgagacagaagaacatggtgtggatgccagcagctgctttgcaggtgggaagatgactgtgtttctgtccgatagctttagtgagtgtgagctgtttgagagtgaggagcctggtagaagaggtaagaatctgaggtttgaggagagaggcagaagctctgatactaagcagtaagatgacatgcaaattagagaaagggagacctccctcaaattatttccctgccatattttagaaaattatttatgacatagaatgtagtttagttaaaaggtaatgacagcccttggaggtatgagtgtacatcttgcacaaccagcaggctggggatcatggctcatgcctgtaatcccagcactttgggtggtggaggtgggaaggttgtttgagtccaagagtttgcaagcagcctgagcaacgcagccagatccaaattaacagcaagaaaaacaaattaactgggtatggtggtgcacacctgttgtcccagctacctgggaggctgagatgggaatcacttgagcccagaaggtcgaggctacagtgaactatgattgcaccactgtgcttcagcctggatgacagaccaagactctgtctcaaaaaaaaaaaaaaaatccttagctttttcagaaggcataaaatatacattgcagaacatagagccttattcaaggaagattgctgagcagttttgaaaggctagatgagattgattgttatcaatgtaaacgatatttttaaaaattcacagcgtagtaataatatgtcattaattgtaaggggagctggccacagggtctttgaaaacatgcttagagtattggttctcaaaatataatgtgcaacacagtcacctggggagtgtgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcacccaggaagcgcaaggggttggggaattccctttcctagccaagggaagctgtgacagatggtacctggagaatcaggacacttcctgccaatattgtgcttttccaacagtcttagcaaacggcacaccaggagattatatactgcacctggctcagagtggcccacacccacagagccttgctcactgctatcacagaagtccgagatcgaactgcaaggcaacagtgaggctgagggaggggcgtccaccattgctgagacttgactaggtaaagcagccaggaagctcaaactaggtggagcccactgcagctcaaggaggcctgcctgcctctgtagatgccacctctgggggcaggtcatagctgaacaaaaggcagcagaaacttctgcagacttaaacatccctgtctgacagctttgaagagagtagttctcccagcatggagtttgagatctgagaacagacagactgcctcctcaagtgggtccctgacccccgagtagcataactgggaaacacctcctagtaggggcagactgacacctcatacagccaggtgcccctctaagacaaagcttccagaggaaggatcaggcagcaacatgtgctgttctgtagcctctgctggtgataaccaggcaaacagggtctggagtggacctccagcaaactccaacagacctgcagctgagggtcctgactgttagaaggaaaactgacaaacagaagggaatagcatcaacatcaacaaaaaggacatccacaccaaaaccccatctttaggtcaccatcatcaaagaccaaaggtagataaaaccagaaagatggagagaaaccagagcagaaaagctgaaaagtgtaaaaatcagagaacctcttctccaaaggaacgcacctcctcgccagcaatggaacaaagctggatggagaatgactttgatgagctgacagaagtaggcttcaaaagatcagtaataacaaacttctccgaactaaaggaagatgttcgaacccatcacaaagaagctaaaaaccttgagaaaagattagacgaatggctgactagaataaacagcgtagagaagaccttaaatgacctgacggagctgaaaaccatggcacaagaactatctgatgcattcacaagcttcagtagccattttgatcaagtggaagaaagggtatcagtgattgaagatcaagtgaatgaaatgaagcgagaagagaagtatagagaaaaatgagttaaacaaagcctccaggaaatatgggactatgtgaaaaggccaaatctacgtctgattggtgtacctgaaagtgacggggagaattgaaccaagttggaaaacacccttcaggatattatccaggagaacttgcgcaacctagcaagtcaggccaacattcaaattcaggaaatacagagaatgccaccaagatactccttaagagcaattccaagacacataaattgtcagattcaccaaagttgaaatgaaggaaagaaagttaagggcagccagggaggtcgggttacccacaaagggaagcccatcagactaacagcggaactctcggcagaaactttacaagccagaagagagtgggggccaatattcaacactcttacagaattttcaacccagaatttcataaccagccaaactaagcttcataagtgaaggagaaataaaatcctttacagacaagcaaatgctgagagattttgtcaccgccaggcctgccttacaagagcttctgaaggaagcactaaacatagaaaggaacaactgataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacagagacacaaaaaacccttcaaaaaatcaatgaatccaggagctggtgttttgaaaagatcaacaaaattgatagactgctagcaaggctaataaagaagaaaagagagaagaatcaaatagatgcaataaaaaatgataaaggggatatcaccactgatcccacagaaatacaaactaccatcagagaatacgatgaacacctctatgcgaataaactagaaaatctagaagaatggataaattcctggacacatacaccctcccaagactaaaccaggaagaagttgaatccctgaatagaccaataacaggctctgaaattgaggcaataattaatagcctgccaaccaaaaaaaagtccaggaccagatggattcacagctgaattctaccagaggtacaaagaggagctggtaccatttcttctgaaaatattccaatcaacagaaaaagagggaatcctccctaactcattttatgaggccagcatcatcctgataccaaagcctagcagagatacaacaaaaaagaattttagaccaatatccctgctgaacatcgatgcaaaaatcctcaataaaatattagcaaaccgaatccagcagcacatcaaaaagcttatccaccactatcattttggcttcatccctgggatgcaaggctggttcaacatacacaaatcaataaatgtaatccatcatataaacaaaaccaaagacaaaaaccacatgattatctcaacagacacagaagaggcctttgacaatattcagcagcccttcatgctaaaaactctcaataaactaggtattaatgggacgtatctcaaaataagagctatttatggcaaacccacagccaatatcatactgaatgggcaaaaactggactcattccctttgaaaactggcacaagacagggatgccctctctcaccactcctattcaacatagtgttggaagttctggccagggcaatcaggcaggagaaggaaataaagggtattcaattagggaaagaagaagtcaaattttccctgtttgcggatgacatgattgtatatttagaaaaccctgtcgtctcagcccaaaatctccttaaactgataagcaacttaagcgaagtctcagggtacaaaaatcaatgtgcaaaaatcacaggcattcctatacaccaataatagacaaacagagccaaatcatgagtgaactcccattcacaattgcttcaaagataataaaatacctaggaatccaacttatatgggatgtgaaggacccttataagggtgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagccctcggaaataataccacacatctacaaccatctgatctttgacaaacctgacagaaacaagcaatggggaaaggattccctatttaataaatggtgctgggaaaactggctagccatatgtagaaagctgaaactggatcccttccttacactttatacaaaaattaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaggaacttctgcacagcaaaagaaactaccatcagagtgaacaggcaacctacaaaatgggagaaaattttcgcaacctactcatctgacaaagggctaatatccagaatctacaaagaaattaaatttacaagaaaaaaaaaaacccttcaaaaagtgggcaaaggatatgaacagactcttctcaaaagaagacatttatgcagccaccagacacatgaaaaaatgctcatcatcactggccatcagagaaatgcaaatcaaaaccacaatgagataccatctcacaccagttagaatgacaatcattaagaagtcaggaaacaacagatgctggagaggatgtggagaaataggaacacttttgcactgttggtgggactgtaaactagttcaaccattgtggaagactggtgactcctcaaggagctagaactagaaataccatttgacccagcaatcccattactgggtatacacccaaaggattataaatcatgctgctttaaagacacatgcacatgtatgtttattgcggcactattcacagtagcaaagacttggtaccaacccaaatgtccatcaatgatagactggattaagaaaatgtggcacatatactggattaagaaaatatggcactatacagccataaaaaggatgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgactttataatagcctagacttgttcagttgtggattctgttcatctgccaaacctttaatgagtgcctcagtgctggccactatgctggggacaatcctcctgactcccctgactccctgccaatcaaagactgctatggcttagaatgatgcatttgcatgtagttgccttactgggtaatgagatgaccaatgtcattattaactggctttgttagaaaaattcccccaactagtgtaaattagttcaaccattgtggaagactgtggcgattcctcaaggatctagaactagaaataccatttgacacagccatcccattactgggtatatacctaaaggattataaatcattctactataaagacacatacacatgtatatgtattgcagcactattcacaatagcaaagacttggaaccaacccaaatgtccatcaataatacactggataaagaaaacgtggcacatatacaccatggaatactatgcagccataaaaaaggatgagttcatgtcctttgtggggaatgaagctggaaaccgtcattctcagcaaactatcatgagaacagtaaaccaaacattgcatgttctcactcatagctgggaattgaacaatgagaacacacggacataggaaggggaacatcacacaccagggcatgtcggagggtggggggctaggggagggataatattagcagaaatacctaatgtaggtgatgagttgatgggtgcagcaaaccaccatggcacgtgtatacctatgtgacaaaaatgcacactctgcacatgtatcccagaacttaaagtataattaaaaaaaaaatcccccaactgataactgctatagttaacatctaataactactgagcacatatttggtgccagacacagagccaagccctttactgacattatgactttttcatttttacattatcttattaagtagctttgattgctgatgttttagcagtatgaatgctaaggttaagaaggttaagtactcagcctagggtctcagagccgctgggtggcaaaatggagattagatcccatcataccaaatccagggcccctcctatcatatttcttctgcctttcaggtttaagcaaattaagtggaaaactcccattaccctttatcgtagaatcagatggtctctctactgtacctctcagtatgctattgctattattcaaaatgtgttcattccctaaccatttctattttctagagatttcccaggtagctaatcaatttagaaaagtaactgcaacagcctagttttaaatttgattttcattcaaactttattaatttagccattagttttcatttaaaaggaaaggcattttaccaacatgcatatcatatataatcattacaactaatttcccaaattataatcaacgttcattgcaattactggtattttacataaatattataaaagcaatgttatgcatggttccatatcattaacaccatactaaatttacatataaaattggatataatgtgccctaggaaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcctgatatactctgtccagcctctgccccactctccattgcttcccatcccattccaagcctttgttctcttaaggagctcctgactgtcctttagacagtccatcagttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttgatccagaagaattaactctgcctcctttagtttgtgctttcttcacaactgcttaccctctttctgtagaggactagagtttgagattcacaggaagaagcaacctacatagaggccattggtgacaaacattctctatgagtttctggctggcaatgctgtagtcttgggtgatgagattaacactgggacaagaaatggtcccataggtggatgtgaagattgagacttgtctggaatttgcttagtgtttggaagagaccatctctagaagtaaagtactaaaaatactaccaatgagacagagatgagttgctattattagtgtctctgtcattattagaactttcatcattgttacaactcagaaaatgatattgggaattagagaaggtgaaaaacatacccaaagtcacacagtgaagaaggagtaaatctgggacatgaacttaggtctttctgactctgagaaccaggctagccctcagccagtaccaggctagcccacaggcagtaaagttggctgatggattggggtcattggtgacttgggaagtttctgtggctgtgttggaaggggactgggtggtcctacatgttcctagttgtatgaagttgcatgaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaagaaccaaaattgggtctaaataacatgtaacactgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaatatcagtatgtacttcatagagttttttttttttttttttttgagacaaagtactgctcttgtcccccaggctggagtgcaatggcacgatctcgggtcactgcagcctccacctcctgggttcaagcgattctcctgcctcagcctcctgagtagctgggattacaggcacctgccaccatgcccggcgaatttttgtatgtttagtagagacagggtttcatcacgttggccagactggtctcgaactcctgacagcaggtgatcagcctgcctcagcctcccaaagtgctgggattacaggtgtgagccaccatgcccagccttcatagagatcttactaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaacgtaacatcttttcaccttaaataacttgctgtttttgtaggatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactgacttcttggaatctagatttcagtacagtccagggcttaaaagatataacaatgatctcccttctccgtctatgacctcttcgtgatcacattcctttacataacaaaaatagttactgagtttgttaagctgggattgcctcagtttcttataattttacttgtgaagctgaaaaataaatgttgagattttatagttgagcaacaaaatttacagattcttagggtgggaagacattttggatactatttagcattgtatttacattgaacaaaggtaaaaatagggacttgtagtgacatactgaggtcacctagttagttcatggtaaagttggcaatggaatcaagatattcctataccatctcttagaaatcgaggatactagagtagaaaaaacccctaggattcctttggtgtgactcctgcattttatagaggaacaacttgaggctaagaaaagtaaactactcgaggttacataccttggtggtggcagtctatccacaaactctgaacttagtccaaagttcttaacccaattatatcgagaacacagtgaatatagcaagtaaccctagagttcgttcttcatagtatttgaacaaacacacttgattatcatgccccaggtttgtagaatgaaatcaatctggtttatttctttttcctttcccacacccctactcccattgaattcaagcacgaggaatagaatcaccttcatgtatttgaatatacaattcatgacatcgttactatggtaagacaagttcatatgtgtgaatagtagcttctgtcaataagccctctgtaaatcaccctgaaaattgttagaaatactgtcctaggacaagaaggatactcagtgggtgaagtcttttttaaattttattttaatctttatgtctacagaactcatctgactcaagtgacttgcatacagcggctgcttaaaaaatgtttattgacagattattctgacttgagctcatttgttcattcattcattcattcattcattcattcaacaactgtttattatatgcctagtgtagacaacataagtgcattcctacaacatgagcaggaatagcccaggaaactatgatttttatgggctttaaaaatgtttagtgaactaaaagcttacacactaaagcttctgttgtatgtggagtttaagaagtttttgtgtaaccatataggcaatagcaccaacaaaccgtttcctctctgcttgccttacagtaggcatactttatcccctgccaacaagaggcttttgttcaatccagttttttctgacatccagctcaccaaacaagttgggtttgataaactgtttcacaaagcaatagagaaagctaacagcctgacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataattttaatgtggagctctatccaagttttagtatgtaataacttgatttgaaatgattgaaaaataacttaaagattttcatctgcattggtgctttgatattaatgcctattaagatgttggtaggcactcagatagtaaatataatttttctttaaaaaatccatgggttttaaacaatttagaaaaacatgaggtagttaattaattccccaaattaatctctcattaatgcagacagtgaactcattataatcctggcatcaggtactattaccaatacctgtctgtggtttgttagaagggccctcccctctgcactgtagtaatgagatggggtgggagagttgtcatccaaagtatatccaaattcacttaataacagtcttcctgtgttttcttagaattctaatttaattcttttaaaagtccaccgaaaacaaaaatttgttttgacatgttaggcacaaaattgttttaaatccactaaactagctaaaaccaaatggattaaaaccccaaaggaaatctgacttttgtatgaaacaactaatacttaagtgctgtacacttttcaaagagccttttacagatattattccactgtacagtgatagccagccaccatgtgaggtgggtgtcattcattcattcatgcaaaaagcatttatcaagtgctattacttgtcagccactgtcccatgacctgtggatacaacagtaaacaaagtggagaaatcctctgttcccctggagctgacattctagtggagagaaagaaacaacaatggtacaagtgaaatatatattattggattgtctcgagtgccgaaaagagacataaagcaggggaaggggatggggaatgtttaaggtgttgcaatttaagatagagtggtcagggcaagtctcactgagaaggtggcattggcgtaaatgcaaaggtgatgagatattgagatagatatttgggagaagataatttcaggcagagggaacagcaggttcaaaggcccaggagcagcatcatggctggtgtgctggtgggatggcaagggggccactgtggctgggtggggtaagttgggtgggagaatggtagaggataaggcagagaagggacaagagacagtagccaccatttgtaggccactctgtaggttgtggcttatgttctatggaatggtatggtttcgaacaggcagtaacatgatttgcttgcattttaacgggatcactctgactcattttaagagtagaccatggttaggggaggggtcatcagaatcagagaagtcagtttggagactactgtgtttattttggcaggagataacggtggctcctttaagtggaaagtagtaaaaaaaaaaaaagtgttggcaaggtcaatggcaaagtcaactctggccataataacagagagaaacagttgtcccctatattgagtagatgtcaaagttgaaaggaagtactagatggttccctcttgtcttgagataaaaccttcttcctgaactcccgattcatggactccactatcccatcgcatcactatctttttcctccaattctgaatcctatttatctcttttcttttctatcctaaagctattaacatctccttctttaccagtcttccctgtgtataaacaatgtccagtcttttctacattaaaagataaagtcttccactggtatctacccagcactatgatcagtttcctcatcacttcactcttccagcaaagctttttgtaagtgctgtctctattggttgtcgctgttttcttctcatcgtccttttcaccctctgcaatttggcttctgcttgtgcgctccactccctagtagttcatccagggcacttgggctgtcctgatcatgcccaacaatgactcccatgttgccacatcccaaagagaccttctgatccttaccttactggacttcatcatttcatttctgaactatctatctctcttgtgtttatttccataaactgttcattctctgtctcctttgttgatcccttttccttatggttcttgacatgtgttctggagtttcatgctggcctcatggagcttgcaaccttttataattcccccagtaacctcatctacatcatggatttaaccactacttcttgattaataattctcaaatctctatctctttctctgacttgtcctctgagcctcacatttgtgccaacttcttgttgagtctaaatccccacaggcacctcagatgtaatttgtccaaaactgagatcattatcgccctattcctcctgtaaagagtcacctggtgtccatgatggaatcctggaaggtatcacaaactcctctcttcatctctttatgccacaaaaagttagttcatcactaaattcttccatttttgtcatctaaatatgtctgtaatctgtccccacttctcattttctcctatgcatatacttatttaaagaccttattgttttgcctcctacagcagtaatcttctaattagtctccctgcctgcagtattgctgacctcaagttaatcttccactgacctatcagtgaaatgtatcccaaacacaaatcaaatctgactgtaaaagatcccacttaaacttatcagtggctttgcatcacctcaaggataaagtcccatttcttcatatggcatccttgactctctaggacatttcaccctccattgtacactctctaccctagccacacccaaatcctggcaatttcctgcaaatgcccatcttcagttctatgctctgaccctttgtttacaccccatttgcctaaaatgtcatgtccctactgccttttaaagcgggaagacatcatactcagaagtgaacttctcctgagaggtataatgggagagcgaaagactatacactttggaaatggatcaaactctctgcaccttagtttccacgtgtgtatctttaaaaaaatgaggattataggtagggttgttggatggtgaggcatgccagggacaggcacatattagatgctttctgaatggcaacaacttcagctcaggttcaactcatctggagagtctctttttatgtcctctctgtcctgcagctaatttaatcatgccagcactgtgctctcagaatattattttttaactcccataatcacagttatacttgagtttgacattgtccatctgctacactaggtataacattcttttgggcagagattacatcctattcctcttaattccccctacgtgatcagcacctcatgcatggctaggcacaccataggctgtgggacaaatataagttgggcatctgttaggtaattgaaagaaaaactataaggtccaatggcaagaatatcttttcactcatctctaacatgcatgtattatcattacgctatccttgtgttttctttccaattaaaataatatctaggatggttttaattttctcagatgagggagcacagtaaagaattactgaaagaaagaggaacagcagaaaatatacaaggggaggctgcagaaaatctaggttataacccagatctgccactgagtcaatatgtggccctgagcaaaccatttaccttctccaatccccagatttcatatctataaattgaggataattacatttttcctaattttcagagttgggagaatcaagtgagacctacaatgcatgtgaatgagctttgtggcatttttgagcaccctcataatagtcagaaaacattgtgcatttgagagccacagtactgggcacacagtaatagttgtattaaactaaagagcagcctcttggatatttgataatttctaagtcgctggcttttatggtacattaaaaattatatacacttgcatgctgtgcattaattcttttacataacgattaaaaatgtagcatcatgctatgaaaaattaaactcaacactgcaagcataattgtaactctgatagtatgttaacaagtccacatttgtacttacctccctgtggaaagaactgcgagtaaatctctttgaaggtttcttcattaacaacaccactggggcattcctagggaaagtggcagagaagcaatatgagcaaagtgttcataaaactgaattttttttgcacattttgaaacagaactgtctaccatgcaaagctgcaccaagaaaattaaccattcatccattattacaaagggaataaaagcacactataaacttatgtttgttccagttctcacaagaaaaaaaaacgtagatgtaaatatctttgcatattgagtatcaaagtaggtgtaatgtattcagaaacacagtgctgcttttaagaacacatatgtttattataaagtaaaaggaaattgcattatttttcacacagcaagcatgttgcaagatgtttataatatagtctttggtgaatcttggttttgtcctttcaaggttttctgaactcacataatcttcgattcaatggcagaattactctattggcatctctagtggctcaagaagcttcaaccagtaatagatactaatgcttgttaacaggatgtctaggcatacccaagacatggttttgtaacaagtgaccttgggtgagatagaaccccatatttttgaacttccggaaaggagagtctgcaaagaaatggcctggcctgggcttaatagatccccacctttgtccctgggtcaacttgtcaaagaatgatggacattgatcttgggaactacacccatgttggacaactgacctggaggggccacagggcaaggttagccctctgagagtggttttggcatttttgctaataaaaaaaagaaaaaaagaaactttaaagtgtcagaagggggctgccttggtgcagaatataaggtttgagcaagcaaattgtcccccaatctctggaaattcctccattttttggagttataagaaccagtgtggttaagaatttaggcgtagaggccccttgagtggtggagactgacaatcacatgatagcccagaattgaatcatgtgagatattaactgtatggtgatcccttgttatccttggggcattgcttccaggaccaccgcggataccaaaatccatgcacattcaagtcccacacttggcactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgtaagtggagaagtggtaagttctgtttagtctcttttagtagattctcatgaacagtcccatgtgatcagagctcccctgactctagttgtcacagcactcccacgccacctaacgtccacccaggactaagttcactggggaaggatgaatggtgtgctaactccccaacagacctgactttagacatgaatattctgtgtactctaaatttgatactgtttccagcatctttatcaatcacctatggtagtatttaaaacatcacttaacccttaaaatcattgttccctcactaataaacttactttctttattccagtgagtcagttactcaactgtaatgtgcttcacctgcagaattttctattttctcatttgttgttttgaaaggtaggacctttgatacataaacagtgttaacagtttcaatgtgaatttgtgtttacagagcttctcgatatggttttatcccatttgttaatgatgagcttaggtaggcaaaatagctgcattcacagaggcagaactggaggtgctgagtggcaaagcactttgttacacactaagccagtggggaagctggaatgtgggcttggaactctccaggtcatgacaaggtttcgtattagatgacccctgtggaaataatgatgacctcaaggacctaagagaattggagtaaagaaaaaaacaaccaaaaacaaatgagcaagcaagcaagcaagtgaactgtgatggttgattttatgtgtttaacttctctgggccatagtgtccaagtgtttggtcaagcattattctggatagttctgtaagggtgtttttgagatttattacattgatgcaaaattgcggcttttgctattactttcaatacatttaagctggtagactttaagtaaagcagattgccctccacaatgtgagggggcctcattgaatcagtttaaggcctgaacagaacaaagacggaccttcccagagaaagagtgttcttcagacatcatctgtaatattggcttcccttgttcaccagcaccctgcctttggacttgaactgtaactgttttctgaggctccagcttgccagaccccttcattagatatcaagctggccaaggctccacaaagtgtgaaccaatatcttaataagtctctttatactcacacatcctattagttccatttctctgaaggaccctaatacataaatgaattaacaaccaatagctacaactccaaaggtggtatgtatacagctaatctctcaaacattttgactatctatctagctgacaccaatggacccattttaagactaaacactttgcagttagaccctctcacacatggaaattgtgatttattggctatttaatgctaagccagttgcttgggatagtaaggagagagtaaatacctggctctctgccatcaggtggcaagcttgtgcaaagttagagctggaaagttgcctgggagttaaaagttgatgctgataaaggaagaggacttcaagcaaagggacctctgcatcaacaaatttgttagctgccttcagtctctagatatatttgatagatataatgtgaaatgaatttgtaaactgactatctgatatgcatgtgttttatgtttaatcacatatctgtgtcagaggaaaccttttctctgccaaatgaaaactactggccaagtttcagggtggaaagtctcaccagataaatttgtttttatccaccttatattcattacattagtttacatctctacaaacacatactgtatgcctattattccaggagtcttctaggaactgggactgctacaataaaccagtcaaaggtcttcccatcatggaacctctatccaactagaagaataaagactgtctttgttcaggctcctttaacaaaatgccatagactaggcagcttataaacaatagaaatttatttctcatagtactggaggctaggaagtctaagaccataggattagcagattcagtgcttgatgaggccacattcctggttcatagatggcatcttctagctgtgttcccacatagtggaaggggcgagctagctctgtggggtcttttataaaaggacacttatctaattcatgaagtctctgtccacctgatctaatcatctcccaaaggccccacctcctaatactatcacattgggggttaggatttcaacatatgagttctaaagggacacaaacattcagaccatagcaaagaccaataactaaatattaaaaaatcaaatccaagaatgatgatcttttatttattcccagagattttttattgaaactagtgcatttttttaaaccttcaggtgagaaaaagatgctagtgatttacaagatggtatacattctgtaactttttcttcacctcttctgtgcagtgatctctccataaaagtggtctctctacttctctatcaagaatgaatttggccaggctgcatgtgcagcaaagtgtaaaacataaacaatgtgctgtattagttaactcttgctgctgtaaaattaggccttcaaatgtcccttaatcaaaatgcttgggaacagaagtgtcttggattttagattttttgggatttggaatattcacattacactcagcagttgtgttagttcatttccacactgctataaagaactgcccaagtctgggtaatttataaaggaaagaggttaattgactcacaggtcagcatccctgggaaggcctcaggaaacttacaatcatggtggaaggcaaaggagaaggaaggcaccttcttcacaaggcagcaagaaaggagaagtgctgagtgaaaggcaggagccccttataaaaccatcataactcatgagaactcacccacttatcacgagaacagcatgggggaactgcctccatgattcaattactccacctgctctctcccttgacacctggggattatggggattacaattcaagatgagatttgggtagggcacaaagcataaccacatcaccagttgaacatacctaacctgaaaatctgaaatactccaatgagcatttactttgaatgccattttgtctctcaaaaagttttggattttacagtattttgcttttttggatgagggatagtcaacctgtataacacagttaaaaaccacgtagtatatttcttattcacataacaatcttgggtgagtgtacagatcagctgatggttcttctagggacagaggctaatgaagatttggtgactttaacatatggcgccaacagtctctgtgactgtgtcatccagaaggaggaaaagaacgctgaaaagagtacatggaaactttttatgggccaggtcttaaagtggtatacatcatttctattctcattttttttgttgttagagatcacttaatgtgtctaccccaaacaaaataagaagtctggtatggccagaaagaagacaagaatgcagatttgtaaagagtttggaatatctatccctgtggcatgtttgaaagatactccaagtgtctgtgttctgaaacagttctcccactgatgctttatttattgatttttattttgtatttttgtaaagatgggatctcactatgttgcccaggctggatttgaattccctgccacaagcaatcctgccttggcctgccaaagtgctgggattacaggtgtgagcccagcctcccactgatgttgtaacatgaagattatcaagtcatttagcagtataaattgtctccatttcccaggtgtcatttttaaagactgtttacttgcttcaagtaaacaagtacaatgaagcttaaatgtttgagcatgaattttttcattagatttttctaaggatccaagaagcagtagggttcctgggtttagggatagtaagaaatgcctcactcatccatcttctgagaatttgctgcaagcttctactaacccttatggttctgtattctattttctaatgaaattttgtctgattattagcaaatgattattccatgaaaatatgccctctatagaaaaaaattaaagaaaatgaaaatcacccataatctgactactgtaagagtatattggtcatttatataagcatatataccgtagaaataaagttttaataagacaaaattatagcattttatgttctttaactttaggaaatatcctgaacattttttacatcatgatttttagtgactgcataataatgcatccattgaacttaccatactgttgcatattgaggcgattttggcatttttgcactacataggaataatgatgtaattaatattctatgcatccttctgtgactgcacttgtggtttcttctttatgactaatcccagaaggagaatcgtaagaccaaccagtttaaaccattgaaagctctttctatgcacagtcatggtgctttccagaaacgctgcatccattcgtgctgccaccgcagctttatgagaaagtctcacaccgagaggagctaccgactagaatcacatgggaattggacacacacacacacacacacacacacaaccccatgaacaaacagcaataatttgcttccctcatgaatccaatcgtcattctgaaaattaccagtggacattgaggcgtttggacaggtccctccgaggcataaagcaatttgcctgtttttcacacagacagggtcgctgtgatggcactcagccggaccacatcaccacaatcacagcggtttattgaggataaaataaacaactccattccttcttatgcagaccattacttttaacactttcatcaaccctgaaaggtgggtattatttagacatgaggacaatgagcttggagagatgaagtcacttgtttgagtcacacaggttttgacagagacatctttttgctcatttattcaataagtagttatttaatgccttctaagtgtcagcaaatagttcatatgccttttactattctgggcactggagatacaggaatgagtttttaaaattccatttcttttttgctcttgtggaatataacatttagtggaatcagactcataactctgactccatgaattgcaatgctatcttgccttctggattattactttttcttctattaggactgaaaacatagtctcctggagagtcatctgtggaaatccttcttctgggaagatgtacacggtgtatttgtacccagaggcacccatcacagctgcgttggagagaggcatgtgcaaagggaagccatttcaatcaaaattgggatcaccgattaaaatttattgtgcattgtagcttgagagatttgaggaaagcaatctttttctttttagaaatctttggttttagtgtaacaagaacctccccaccttcctgtgtgccacatactctttactgtcattgtaaatggctagatagtaatgggctgaggaaaatgttctggtttttaggaccagtcaaatgaactgctccatccagtatttaggagctggaggtctctggttctgctggctggtatacttatctatgatgaccattgcatttctttcattgcctgtgaaacccttcactgtgatatgatcacaacacaataaaagtagaatgaggttttctttgcaatataactgccatagatttgtctgttggtgaagaaacagtcgccttttggggccttactgctgtgttccctgatgagccttttcagtcctctcaggccatgtggggacacatgtgagggtcaagattagttgtagatatgcaatgaatactatgctagtactaatatcaattttaataaggcagtattactattgtaataatcagcataaagtaatactttattggtattgatattttataattattaatgtgatgatgacaatgatgatactgatgatattaagctaatacacatgagcactttttatgttccaacccttgcattaaatgttttacatggattatctcgtgggaatagaaagatgttagtattaactccattttacaaatgaatgaactgtcttagagaggggccactgcattcccaaattagaaaatagcagatctaatctatagatcacagaatcaggaaacttgagagtttaaagcaactttagaggccaggcacggtgggtcatgcctgtaatcccagtactttgggaggccaaggtgggtggatcacctgaaatcagttcgagaccagcttggacaacatggtgaaaccctgtctgtactaaaaatacaaaaattagccaggcgtggtggcacatgcctataatctgaactacccagcaggctgaggcaggagactcacttgaatctgggagatggaggttgcagtgagccgagatcacgccactatactccagcctgggtgacagagcaaaactccatctcaaacaaacaaacaaacaaacaaacataaagcaactttagagacaattcaattcaatgtcctcattttgaaggtgaggggatagagattaaggaggttataggaactgaccatagatacacagggggctgctaagcctgacctcatgtctaggtttcctgaggtctaggactaagctttgatactgcaaatgtcttcgtgtccatacaatagctggtaatttttgtcaggtactatttagaggaatctagtgcagtgcttatattcttgggctctggagttaaatagaaggcctgggttgaacccctactctgccacttgggagctgtgtagcttcaggcaaactgtttaatctaagtctcattgctctcctctgtgaaacggggacaggaattgacctcagagagctgctataagaatgaataagatacacatattatgctattatcctagccctctaccttacacatcatatttggtcatttaatattagctgttagtaccatggtaatagtttaggatttggtaagcagaactccatcacgcaatgagtcactgtaacatcaatgccgatagaccaaggataaatcatatttatcaacgtggttgaatctagaataacacaggtctgaaatgcaatcagcttatgaagtatatatgaattacgctttctattctagtgttataagttgaatcactctatctaatatcatcagaatttaccctaaaagaaaggaatattgtaattgtaaatgatagcagaggagaataaaggccaccatcatggaaataaatgtcagtagaaacccaggagcctcttatttattaatttaaagttttccccagcgatgcttacatggtatgtttgaaatcatcatggaaagtgttgggaagggtgctttggagaaagatccatgtatgcataggaaattgctaagaaacatattttgtgagtgcttcaagagttcttatactttcaccttataaggaaacctttcagcatttcctggaaggttttcagagctctgttgaaatgcatgagaaatagctgcagtggtatgcaaatcacaggtataataacatcatataattataatattgtccactccaataatctttgcccactctattagctgaaatcttctcttcccctaaatcattctgttctgatatgtgtcttctcctcaggatcagaattgttattaaacatttagagacttcttcaggattaaaaaaaagaattacagtaagacatttcataggaaaaaaaaactaaaagtgcttgtgaaatagttatttggggatcctttcatgatacctgtaatgccacatctcttaggcatctgtatatttcaccaactctcacacccatctctggtgctaaggagaacatacaaggtagtctgctcggtctatcagttaaaatagtatttagcatgtagtatgacaattcagagattctctggcattctataattgcaggagaattttcaaaatttaaatgacacaatcctacaacctgtgctgctgatatcaccagattctgtggacttctctgctctctttagagttagtaaatacaaggcagggactaacctttacgatgtttagaatagggaatactaaaaatatttatgctgaatgaataaatcttcagtcagttcttagcttttaataaattagaaaatgaatttgctctgataatgtccttcaaaacttgggcctacatttttagaactcctaagaccaagaccaagatagtcatgggggttccgatatccccatgattgcccacaatgactatgatcgcagaaattaaggggagatggctaggatcaagaaaaacacttcttatttcaacataaaaagcttaacatagtcaaaaattggattctaaaaagctcatttaaaaattataggattaacctttcagttttcaaagcagaaaagctgatcattaagaactagagctggctataaatttctgttctaatatgcccaggtgtttgaactcctagcaactcatttattccttcttagtctaaatgttctcatctgatataacaggtaagtaatactaacatcacaggtaagcaaaagaaatgcaaactaaaatagacaatggatgaaagaaacccaaccaattttaaaaactgaatatactcaacatgttggatattttcttgtttccaaaatctgcattaactgcctcttccatttcctgaacacacttctggggtcaaagtggttaaataggcactgcagattaaaaaaagaaacagccaatggtgggaaaaggctgacctagatactatccttggaaaaggaatgagagctgggtgaccaagattcaattcagctgcaaggatgtgggcacattctgagccccacgagttctcagggtcacccaggatgaagcagaaatccaaggtactaggcaaaggttctctccccttcagttctgccctctaaccatatggaagaaggaaatcacatgagatttacagccaaaaaaaaaaaaaaaaactggctcaagtttcagctctactactaatgaagaaataattgaaaagttctgctttgagtcttagtctttaaaaatgcaggaaacaatagcatcttatagtaaagaaatgagaactaattggcattatgtatataaagattctagcataatactaaacattctacaaattgtacttatttttactattatctcttcaagtaacttaagttggttctgcaaaaagagattttccaaattttgtaggaaaaggcttcctgggattgggcccaattcctgaatctttagtggaatgcatgtagaattgtttgatttacggagacttttaaaaggattttcccaactttatccagaagacagtgtccattttgtcagggtcttttaaaaattatgatgtagtgaaattctataggcacccaaaaccatttagtggaaaaaaaagacaatggtgccctgggacaaagcctatgtatcagttttctattgctgcataaaaaatgaccataaacttagtaactctaaacaacacaaatgtatcatctcacacttctgtgggataaaagagtctgacatggcttagctgtgtgctctgctcagtctcccacttaaactggctatggttctcatctgggccttgcagtcctcttccaagctcactgaggttgttggtagaattcagcttctgtggttgtagggcccaggtccctgtaaccttttggctgtttactgggggcttctctctcagcttcattccatcttcaaaccagcaaagcaaaggcctgttgagtccttctcacactctgattctctctgacttcccctttggtaaaggactcgtgtgattagatcaagcccacaaagatcatctctgtatcttaaggtcaactgccctgagactttaattatatctgcaaaatctcatcacagtagtaccttgcttagtatttgattggataaccaagagacagggatcttgagtggctgcatttagatatctattaatacctcccacagcctgcttcttctgaacatcagttcattttggttttcatagcagtttttgtttaacaacagtcttttttttacaattatactcacaagtgtatccaccacaactcgcaactatatttcttggcacctgccatagtttaatgcgatttgaaaagactatattctgtcaaggctttagaatcagcagtgtaaagaccagctgtgaggccaaaattcaatattttttatgagtgctaagaatagtatcccatatgctgagtgttccccgtctagagtatgtctgcctatatccagagcagaaataaatttttttagattttactaattgattagatcactttcaagttggcatgatatcagcctaataatattgaccaaaaaaaaaaataccgagtaaagaattctacttaaaagaaacacgcagtgtttcaatcagaaagaataaaataaaatacagcaggtactccatatcgcagctgcagcatgcacagattcaactaactgtggcttgagaatacttgaaaaaataaaaattaaaaataaataaaaaataaggcaggtgcagtggctcgcgcctgtaatcccagaactttgggaggctgaagtgggcggatcacctgaggtcaggagttggagaccatcctggccaacatggtgaaaccccgtctgtactaaaaatacaaaaaattagccctgcatggtggtgcatgcctgtagtcctggctactccggaggctgagacagaagaattgcttgagcccgggaggcagaggttgcagtgagccgagatcatgccattgcactccagcctgggagacagagcgagactccatctcaataaataaataaataaacaaacaatatgaatgaaaaacaatataacaactatttacacagcatttccatgtattagttattataagtaatctagagatgatttaaagtacatgggaggatgtataggttatatgtaaatactacaccatttcatataacgagacttaagtatccccagattttggtatccatgggggagggttctgaacccagtccctcaagaatacagagagatgactgcatggagatgatggtatacacatatgttcatatatatatacatggttgtataaagcctttttattccctgaagatttaaaaaaatctattctctcccagtctgatttctgtcacctactaaattggctagattctggccccttgataacttcatttagactatgatttctggactccttatgtgagattacacattttcctcatgtgtaagccattttttattgatcttttttgttacttatagtcaaaagcattctaacataagctacaaccttcttgtccttgtattacacctttctacagaaagagaaaataaaaatgagttgagtttacaggttgctgacaagtttggtgaaatgtctgctggagaaagaggtgtcgtctatagattacggtggtgggtgcgcatatgcaggtccagatttttggagaacgtcttttaaagtctatccaaagacactttgagaaagcataggaattgggggtgaataaaactcactttttttttttttgagacagaatctcgctctgccgcccaggctggagtgcagtgctgcgatctcggctcactgcaagctccacctcctgggttcaagtgattctcccgccttggccttcctagtagctgggactacaggcacccgccaccaagctcagctaatttttttgtatttttagtagagacggggtttcaccgtgttagccaggatggtctcgatctcctgacctcgtgatccagccagcttggcctcccaaagtgctgggattacaggtgtgagccactgtgcccagctgaataaaactaaatttaatgatcattcgtggtctgctgggcactgagccatgtggtgtaggagatacatgttctcattaaatccctgagaagtagaaaaggtagatgttttaccacacaatgtttaagaaatgagcacagggaggtttaaagaactttcccaaggtcagtgggactgggatttgaacttgagtttgactgcaaatctttcacatcttcctaagcttgaaaggtgagtgcacctgcggggggaaaagttaactaaggggtaacttttatcccaatgtctttcaatcctattaatcactaaaacacaaagtattcgttatttgttcaacacgtattcatataccaagcacttgactacgcacaggagcgtaacggttaatcaacaagcatggccctcatccaaaggagcttactacggaggaagcagtcagtattcaaatactgacatcaataaatatattgaaaccctcagggcaaagcagcatgaaaacttgaattgttttttacaaataaattgaaatgtcccaggtgaggggttggaggataggacctcaagttgtctggtcatctgctttggtgaggcaggttcaggacaggtcagattcagctctaaatacattttatacattttattatacattttgttccctttctctctctctttctttcttcttttttttttcttccgagtttcgctcttgtctcccaggctggaatacaatggcacaatctcggctcactgcaacctccatctcctaggttcaagcgattcttcagcctcagcctcctgaatagctgggattacaggcgcccgccacgacgcccggctaattttttgtatttttagtggagacgaggtttcaccatgctaatctcgaactcctgacctcaggtgatccgtccacttcagcctctcaaagtgctggcattacaggcgtcagccaccacacccggcccctttccctttcttattgccattctgagaaaatactagtttgtccctcttgcacaagtttttccctcagtgagctaccatttccaggagcagccctgagtctctgaagttaaagaaaaaaaaaaaaagtttagtctgcttaattaagttcttgttgcaaaactttcttagttattactctcagttgtagcttttggaatctaacagcccctcgcttatgagccactcatatcacttactagcctggaactttgaataagttactaaacttcttcaagctggattttatcatcactcatttatgcaggacgtatttttgaaattgttgcaattgttgcaaatacttgagaagtttccaccctcctttgccttctcctagtgcttcttcagaggctatgaagggaacaattatcaagggtcacggtagctgcctaaaaggaacctgtgtctagtacttcagtgcttccgagctctcaggtgggacagtaaagcctctgtctcctctccatgccaggcaaaatgacccaaaaggaaactcccgggcctgttgactctgagcaagctggggcagaacgcttccgagggctctctggagctcagacggcgctcagcgtgagttggaccaaacattcttagggttgtatcatcataatgaggcacaagggggcagtagtgtcctccatgatagctagaaaagcgatttccagttctttttcttaagggattgttcttttcctaagcttggtgcctgtctgggtaaatttctttcaagaaggctatttcctttttatgaacggtgacagcctcattcctacattagataatttaaaaaattaactatttctgggaatggggcccagagactctgatctccattttggatattacatttggtgtacgtcagtctgaattcacaatcacttttttggcagttgggccacctttaatttagtcaccaaaaacttgtagatcttagaaaacaaataagcaagacaacgccactaaagttccaaagcttgagtctgaaaaccttctgaaattgttaagtgtatgtgggctctggagtcaaagctgcttgagcctgctttgctgtttaacaggggaacattttaaacctttaagatgaaaataatgatactaccctatctggaggttattatgaggcttaaataaagataacccatgcacaatgtctagcgtcgtgcctggatgtataaacacccagtacacattccccatggaggaaattatttctacaatgatgctcgttctgaacctgttagcttttgtcatgttttcatgtaatatgggatattatgtttatccttgttaaataccatctgcttatttaatttcagaggattttcagaatatcacaccagtgttccacttccttagttattactctcagttttgtagcttttagaatctaacagccccttccttatgagccactcatatcacttactagcctggaactttgaataagttactaaacttcttcaagctggattttatcataattaattaatgcaggacatgtttttgaaagcatattatatgtcagagagtgtaagaagaaatggagctaaaacaatcaagacagatgaagtccctcctggagtttgatgactatcagagaagtcacacataaaacaaagttctgtgtaaataaccattcagttacagttgcgataagtgctacaaaccaagtatggaaggtctaatttatagggaagacttccctgaggatgtgacatttaaagagggacctgaaggataagtaaaaactagcaggagatattgctggggaagaggcaaaggaaccctgtgtacaaaaacctgtgatgtgatcaatgactaaagagatggcaaatgtgcctggggagtgtggtctgagacaaggttggttaatttggggcctgctagttacattaagaatcaaggtctttgccattcacaagataggtatcatatacctgtttttcagagctctggagagaattaagagatgatttacatcaagtgcccagcacaatcccaatcgcattctaaacactcagcatccctctcttttctgtttactctaccagagttgaatttttacctctggtttattatttattcaatacgtaattatttagcgtctactgtgtatcaggctctctgttataaactgaacaaacaaaaggggaaaagcagacatggtcttgcctttatagaatctctccactgatgagctattatgttctttgtgcatatgaatttatttcaagggaacaatagtttcaacatatatggcgattaaaatcttgtgctcctatctccaaaaattaaaagtaaataaaagcaagcaagcaagcacacagaataaactcacattgccatggattgcaatgtaaataactcaagattatgaacttgtatgtaggagttacttctgcatgtttctttgcttttgctaatgattaataataacgagtccaggccagacacagtggttcatgcctgtaatcccagcactttggaaaaacaaggcaggaggattgcttgaggccaggagtccaaggccatcctgggcaatatagtgagactcagtttcttaaaaaaaaaaaaaaaaaaaaaagttagccaggagtggtggcatacaccttttgtcctagctactcaggaggctgaggtgggaggattgcttgagcccaagagtttgaggctgcagtgagctatgattgctgctgcactctagcctgggcaacagagagagactgtcttcaaaataaataattaaaaagaataatgatgattgtttttacagtatattcttgcacatggtacagatggttagaataaatctctgtactactgaaagtgctaataagtctccattatattatcttaggggctaagtatccttcaggagggcagaaagactcccagctattaggtgtatctaaaccccacatggctatgtttaccctgaaactgaggcagtctaactcttattcctttctgtttacctgttttaatatattgcatatttatctatttaatatatacaaatgttgtcttctgataaaggtccagaaattccaggcatataaaagagcttcaaatcccaacaattctaccacattcacttttcatttccatctgcacatttttcatttttagagctcatggatagtctagacatttatttgcaaatattatgaaggtattatttcaatcagcaagggattctcttcaaaacttatatgagcttatggtaacaattcttattctctctagtgaggcataaagctaaaagttttatgtttttgccccgtaaggaaggaaaaacaatgcatgtttttgtttttttctagtatctcacagatattttcatttcctggtttaccagttgttaaccttaatgcatcccagaaggagattaatatttggatttaaataataggagctctactttcggtttcttgttatctttgctgggagatgagaagtctggggtggtttattctctgtacaacctctcaaaattgtactatagaccaacatactgaggaagataaggagcaatccctccagtacttacaatgctcatatgaaaatagatgattttctgaaagaattagaatgctatattttattaattgtttctagttagactttaattccaacaactaatatctccttctttaagaatgatttccctaattctaccgttaggaaattatttaattctaccataattatgttttatttttttccattttatgccactgtgccaggcactgtccattttatgacatatttgtgtcagcttaacaaatctagctcatcagttcagaatcaacaatgaaccaaatattactgtagattatatgttaatacataggagcacagttattacatgtataactatttctccattttgtgaccattatagggtaattatgaatagatgaaggcatgattactttagatcaaaacacaggcaaaaaaaatggatcttctttggggaaatgttttatgctatagactgaaagtgtgtgtggcctccaaattcatatgttgaaacctaatctccattatgatcatattgggaggcggggtctttgggaggtgtgttagttcattctcaggctgctataaagaactgttcaagaatgggtaatttataaagaaaagaggtttaattgactcatagttccacagggctatagacgcctcagaaaacttagggcagaaagggaagaaaacatgtccttcttcacatggcagcagaaaggagaagtgccaggtgaagggggaaagccccttataaaaccatcagctcttgtgagaactcactcactatcatgagaatagcatgggggcaactgcccccatgattcaattacctcccactggatccttcccagaacacatggggattatgggaactacaattcaagatgagatttgggaagggacagaaagcctaactgtatcaggaggtgattaggtcataagacttaagtttttaatgaataggattaatgttcttataaaagaggcccaaagagctgctgtgcctcctccgccaagccctagtgacataatggaaatatggtcttccatgaaccaggaagagggactttaccagtaaccaaatctgtcagcacctcgatcctggacttcccatcctccagaaatgtaagaaataaatttctgttgtctataagccacccagtttatggtaatttgtgacagtggaggttgtagattacagagaaaaagtggaggttgtagattgcagagatgaattagtgtagtttatgaaaccatgaagtttgacgttcctgagggatatcccagagaagttgggaaaccagtaattagaaaggagtttggaactcaggtcagaggtcaaagcttacagctatcagtttgtgctcctttagcacataggtatagagatctcccaaggaaaatacctaatgaagaaaaccagggagctgaatgcacagccttggtgggaagctacatttaaaaaacaggaatgggataagcagtccatgaagaccaggataaagtagacagagaggtacaaggagaagccgtagattatatcaaaggaaccaaggaagaagaggcattcaagtaactcaaggcctccactcccaaactcagcagagacttcagttaggtccagagaagtcacaggagaaagtgttagtagcatagactctgaaacaggctgtgtaggcttgcatctagtctccactactcacactagctgtgtttcttaaattctttgtgccagtttattaatttacttgtgcctcacttgccttatctgtaaaatgggactaatagtatacttaccccatagagttaatacaaccataacattgaccaatatttgtagaaccttaaattcttaactcatagttagaattaaatatatttattgaatttaaatcaagcaattcatagatgtcaagattggaaactattcagtggatttgcaaatgaaatgtagttttgacacacacacaaatcagtacaaggaaaactggggaaatctgaataagatcagtggattacatcaatgtgagtaacctgatttaatattgtactgcagctttacaagatgatactactgggggaaatggtacctggtgacctccttggactatttcttactattgcatggcaacctattgttatctcaaaataacaagtttaatttaaaaatattggtagccatggaaaataaaggtggtcttgacctatgaaagaacaatttaaatgacatggtagaggcagaagccaagagttaagaaataaatgcagatgaggggttatatagactgaacttagacagctgttttaggaattttatgtaagagtataagaatgagacttgccaatagttagagagagctgtgtgtgcatgtaaaagttgttgttattgctgatttggaatgagtatgtcttctaatgcattttttaagggtgaatgagacttgactagcattacaatatgtaaggaggcagctaggaaaagaggaagagacagggaggaggaggaagggagggaggcagataaattataaagaggaatcaagatatcataggaagtgggattgaaaacactagggaaatggaacattcttttcttttatacaggaagaataagtcagcaaataaataccaaacaggtgccagctatacactggacttccttctaggagttaattaagcactgtggttttgattgaataatacagatcaaattcctctgtcccgtgagaaaatgagacagttctgtaggtacatttactgctggaatcagaagagctgtaaggatgtataggcatgttactgtaaatagatgaggagacactagatcatgaaaaagagacaagattatcaagctgagtgtaaaaattgctaattagtagtgactctcatatctggatttttgtttggttttccccagcaagtaatagagaagtggaagacaaatcattctctgaccctagagttcggtgaccccagagccatataggtatgtgacaggttggaaactggcttctcaaaatatattgataacctaatctctggaacctaccttacaagtcccccctgccccacaaccccccccccccacacaaaaaagaaatgaaaacaaaaaaaatttcaggtataattagtttaaggatctctataaggagagattatcctggattatccaagtgggccttttaggctatcccaattgtccttacaggagagaggcagagagatgtgacatacatacagaggaggaagggatatgatgatggaccagagagacatttgaagatgttgaccttgaaaattacagtggtgcagccacaagccaaggaatggtgacagctgccagaagaggaaggaaaagattctcccccagaatttctcaagggagcatggccctgctaacaccttgattttggctcagtgatattaatttcagactttcgacctctagacagtaagagagtaaatttttgttgttttaagcctttcagtttgtagtatgttgctacagctgcattaggaaactaatacatgcatgattgtaggacatggataaggaagtagggatgttcaagggtatttcaggaaatcaaccatatagtgcagattagtatggaacttgtgagactaagaagggctggtgatcccaaaggtcttgcttgcagaatcaatgagcagaatgtagtgagattgagggcttaagacagttgaatggatataaggttgtggtcaaaagggtgagaccatcatttaggatgtcaggaattaagtagtttcaggtaataataaagtccaagtgatatccatcagagtgaaaagtggaatggaaaagaaaataatggcatttaaagagtcaaaaaacactgaagctcaggtgagtggctggtaggcaggtcaactccatggatattactgtcaagccaatgaacaaagattttaaagtcagcgatcaaagtctggaatgagtatgatacagaaactctcccagtaataacatgagacgccctgattctggttctctgtgactcagctctgttagacaattttcttacttcaggaactgccaataccccatttaacatgatgctggtgaggcttttaatcccatttccatgggccacagggctaggtcaaatgatgcaggcttttccaggaacagttctccatcccccaggccaaaatgattggttcagtgtcatgtgactaaaactagttcctgccttgctggagttattagcacggagaaaaggtgagtaaaagagacagcatcctgatacactgttggagccttgatccagccatgcctgatgctgtaagtattcctatcttagatatgtgagtcaataaacctttaacttaagatactttgaatgggtttttgttacatgtactcaaaaatatcctaatttataccagaatagtattattttcttgctctttgttctttacagggtggctacaaaggaatcaatgtagcctcgtagtttctctggatggtatttcagtgctttgggagataaccaccacataaatgagagagttcctatttttctttgttattgttttactatctaaccccagctacaagaaaggatatattggtttattttacaaactttatcttcacaatcagaaggatgtgagctgtagagcattattttaaagaccagtcggaagatgaaatggtgcaaaaaataaaaaaagaagaaaaccaaattaatctgcaaacacattagaattttcaagatttaatttcactgttatttttgcccatttgaagcaaatctattcactagatctctattaaatccctactgtaagccaggtacaaataaatgagatgaacaatttgaactgatttcaagttgcaaagtaacaattatatgatgaatttctttgagaagcaaatgttggtatatcagtccattttcccgctgctgataaagacatacccaagactgggaagaaaaagaggtttaattggacgtacagttccacatggctggggaggcctcagaatcatggcaggaggcagaaggcacttcttacatggtggcagcaagagaaaatgaggaagatgaaagaatgaaacctgataaaaccatcagatctcatgagacttattcgctaccacaagaacagtatggggaaaaccaccccatgattcaaattatctcccattgggtccctcctacaacatgtgcaaattatgggagtataattcaagatgagatttgggtggggacacagagccaaaccatatcattcaatccctggcccctccaaatctcatgtcctcacatttcaaaaccaatcatgccttcctaacagtcccccaaagttttaattcatttcagaattaatccgaaagtccacagtccaaagtctcatctgaggaaaggcaagtcccttctgcctatgagcctgtaaaatcacaagcaagctagttacttcctagatacaatgggagtacaggtattaggtaaatatagccattccaaatgggagaaattggccaaaacaaaggggtcacagggcccttgcaagtccaaaatccagcagggcagtcaaattttaaagctccaaaatgatgtccttttattccaggtgtcacatccaggtcatgctgatgcaagaggtgggtttccatggtcttgggaagctctgcccctgtggctttgcagggtacagcctctctccaggctgctttcacaggctggcactgagtgtctgcagcctttccaggtacatggtgccagctgtaggtggatctacctacagctggggtctggaggatggtggccctcttctcacagctccactaagtggtgtcccagtagggactctgtgtaggggctccaaccccacatatcccttctgcactgccctagtagatgttctccatgagagccctgcctctgcagcaaacttctgcctggacatccaggcatttccatacatcttctgaaatctagacagaggttcccaaacccaaattcttgtcttctgtgcaggctcaacaccacatggaagctgccagggcttagggcttgcaccctctgaagccttggcccaagctctacattggccctttcagccacagctggagcagctgggatgcagggcaccaagtccctagactacacacagcatggggaccctgggctcttcccaacgaaaccatttttttcctcctatacctctgagtctgtgatgggagaggctgctgcaaaggtctctgacacaccctggagacactttccccattgtcttgggaattaacattcagctcctcattacttatgcaaatatatgcagctgacttgaatttctgctcagaaaatgggattttctttcctacagcattgtcaggctgcaaattttccaaacttttatgctctgcttcccttttaaaatggaatgcttttaacagcacccaagtcacctcttgaatgcattgcttcttagaaatttcttctgccagataccctaaatcatctctctcaagctcaaagttccacaaatctctgcagcagaagcaaaatgccacaagtctctttgttaaaacataacaagagtcacctttgctctagttcccaacaagttcctcatctccttctgagaacacctcagactggaccttattgtccatatcactattagcattttgggcaaagccattcaacaagtctctagggatctccaaacttttccacattttcctgtcatcttctgagccctccaagctgttccaacctctgcctgttacccagttcctacgtcacttccacattttcaggtatcttttcagcaacatcccacttctggtaccaatttactgtattagtcagttttcacactactgataaagacatacctgagactgggaagaaaaagaggtttagttggacttaacagttccacatggctggggaggcctcagaatcatggtgggaggtgaaagtcacttcttacatggcagcagcaagagaaaatgaggaagatgcaaaagtagaaacccctgataaaactgtcagatcttgtgagacttattcactaccatgagaactatatggggaaccacacccattatttaaattagctcccactgggtcgctcccacaacacatggaaattatcggagtacaattcaagatgagatttgggtggagacacagagccatagaatatcagttggtaacacactgaactagggctctaccattaagtaagcacacagaaatacaaagttcaaataaggataaacagggaatataaaaactattctgcttaataggaattcagatacctcttaattttttatattatctagtaattaagagtgagtgatattattgggaaaccataaaggatccatttcatcagcactgttttttgtttggttggttggttgttttgagcccttacatatatctggcactgggtaggctctgagaatacaatggaaaaatggcaggcctggttcctgcccctaccctttggttcctgtcagggtattctctgaggcatcacagggtttatccagttcactatttagtaaatgataaaactcacattcaaacactagtgtcctaaaacaatataagtctgtctctcctaaatgagctcattatttttgttttagccacctgagagtagagtttctaattcctatctagcttgctgttcaaataactgataattaatcccagaacattagtttgcttgaattgaaaaggcacatcacgttcaagtgcctcgtttttaatataaggcaaactgaggcaaagaatgttaaatgttcttcacagaacaagaggagaggccacttttcaccctcagcctagtgtttatctgactaaaccacaccgtgaaagataacagtctatgaagacaaaaattacaaggtttagaatcctctttccttctccctcagacaactgggaaataatattctttaataaagttgtggttattggactagcacagtagccaaatttaggatgacttatttattcttaaaggttgggactttcattctggaagtacttttaactgttaaagattcctctttccctttccttcttctttccttgcctccctcatttttcctacattccctccttttttttcttgtattatttcattacacaaatgatcatttattccatacaaagttatggaatgtgtagggtgggtatgctggatgcaagggatataaaattggcacagcatctttcttgctgtcagttggctcacaatcgagtggaaagcaaagatgcattcagtgaatcattacaaaacactgtgatgtgtgcattacggttcatcacagaaggagttttggacccttactgggaagaggagaattaagagctgggtgactgcgaaagatttgcaggggagaaaatggctggagagattttgaaataagggaagggcattcccccattccagcatgcagaactaccacttgcaaaggcaaatacgattttctgcagatcctcccctaaccccaccccagaaactggggatatatatcattgggaagagatacagtttaatagagaggaaacactgttggaccactctcccaacacctgtttctcaaatgtgaggcagggctagccaagcatcccacatcaagagaagattaggatgggggaagaggtagaagtcaggcaggaagaatgtgaaagacaagtaccagtctatgaggctggactggtaggtaggaccaatacttaattttctaaatgcatgccactttccctacagatcaatgactgctagcacttccctacttgcttttctttggatttttttttctttttttttttttttgctactgcatgcttctttgactactgctgccaaccttgggaatggattgatgacccacttgcttctcaaacagctctgcagataccacttaggaagctggtgttcgtgttctcagactgaggaggagcagtgtccaaaatcaattacctgggatggtgtgtgctgatccacctagcaatgaactcagatctttggagcttgtttataacacgtacattgctcaacataccctggttctaagatcagtgatgctatttcagagcacaatggggataatacattttacatttatttaatgtgaattttggaaaaatttgattaaaaatgccacctttggcttttttaaataaagaaaatcacaataaaggatagaaagtaattaatgatttttaaaactggttaaccatatacaaaaatcaactcaagatgtattaaagactgacattgtaagtccccaatctataaaactcctaagaccttggtggaaggatctccatttcttggtgggaatgtaacttggtgcagccactgtggagagcaacatggagatttctcaaaggactaaaaatagaattacaatttgacccaggaataccattactgggtatatacccagaggaaaataaattgttctactaaaaagacacatgcactcatacgtttatcacagcactattcacaatagcaaagacgtggaatcaacctaggtacccatcaatggtgaattgggtaaagaaaatgtacatatacagcatgcaatattcacagccataaaaaggaatggaatcatatcctttgcagcaacgtggatgcagctggaggacattaccctacgtaaactcacacaggaacagaaaaccaaatactgcatgtactcacttatacatgagagttaaggcttgggaacacatggacataaagatgagaacaagagacactaggaactccaaaagaaggagggagaaaagaggacaaggactgaaagactttctattgggtactatgctcagtgtctaggtgttgggatcaatagaagcctaaacctcagcaacacgcaattatacccttgcaacaaacctgcacatgtaccccctgaatctaaaataaaaataaaagccaaagaggcaagttattttagtgattttaaattttctttattatagtcttctatatttttccatatttctataatgagcatagtgttgtagttagcaatagatggaaactttatcagaaaaagaagaaaatcatcacaaccatcaacaaacttacctgggtaatttctgtcctgttctcttacgaaagttgcaaaaataaaaaagacaatttcttgctcatttagaatgtacactgtgctttataatacatatggccactaccaatttcttgcaagtgttttttttagactctgggaatatagtggatgggttgagagaaaaggtaccatttgttaaagagaaaacagtattagactagaaattggggtaggatacagttctttatctttatcaatgatatagccttgaacaactcccttaacatcatagcatgtgttttgttaacgtaagacgggcccgataaagtatctcccatctgccagacaggatgactggaaagaagtataaatattttgtaagctgtaaggtgctctatctatgtaagttgtttttgaggcgattattcttagtaataaataaaatactgcttagaaactcaacgtggacagtcttggtctagggacctacttattgtgcaattggcaaaggggcccttctgagatgatgcataggcagacagtttagatacaaataactagaaatggtcaaactgtaatatctgtcctttcccaccttttacatctcaaaaagcagttttcatgtttcatagtaataagggcttttacatctataaattccctttcaaacgcctacatctctcaacaaatttgctaccaccgcaatttattttttaggtggttttattcagatgaaaatagtttatttgagcactttggagttgctgtttgagaatgctatatgagtattaaatactgtattatatttctgatgctctttaaagattttcttttctgtctgcaatttaattttgtttttagaggttttttctcctcctcttctcatattgattttatttttggcgctattaaaaagtgctcaatgaacaacctttttggaatgaatgtaaataagtctgtatctctatgtatatgaatatttttaagtgcattaacttttagtataagacttatgtaatgattaatttgctcctcaaattctaattcttattcaatcaataaccattgttcacaattttaaatacattttattgatttttgaacatttaggtcattagtagtaagatcaatgttagccataattcacctttaaatttccaatgttcaggttattaaaaatcatttgcttttatttccagcataatttatttttaattgaaattcttccttgtgataatttttctttttaaagcaaccatgtcttctttataactgtctgagtgtccaattacattttcttacttatgaaggtttttaatatctaatcatatcttatgtaatcagtgggctattgtgtaaagtaatagttctttttctcccttatttatagggattttactacacacttccttcctccctatttttttctttcctgaacacctttcacctggtattgtgatagttcatttacttgtatgtattgctcactagatggtaaactctgcggggaaaggaatttttttgcatgtcatgttcgctacatcattcctgcatttagcatatgcctaacaaatagtagtctagcaagtattttaaatggattaattaaggaactctaaactacaagacaccaaggaacagatgttcagataaatacataaagatataatctacatgacaatgaaaaggttatgttaaaagtaaaaccctgaagtgcattagaataaatatttaaaaatactatccaggacatataacagttgctatttttctatttaatgaggtatattttggatcccagtcagcaaacaactctctctaccaaaagtagctgactatagcccagcctgtctttgcagttcatggcagaagaagagcagagaacacacagggctcaggtccagagttagctcagagaaaacagaaaatccaatctcagcacagtaaacatgtaggaattcagcatctcatagaggttactgaaagcaaagaatcaaaaataataaatggttataaatagtccatgctctcagagaactttgagtgcataaacaaaacctataaatcttcagcaaatgaaaataaggctctggttaataaaacaaaacaaaacagaaatggcctagtgtaattgttaagaagaggagaaaaacataccccaaagaattcagtatgtagttggtgaattcagagcaaacaaaaatggaaaattacaccttctcagccacacaaaagaaaagacttctaaggatttaaattaagagtatcacagtgaggaggaaggaggagttgattattgggcaaaatattttgcctctatcaaggcttgagctcatgagtaaaaggtgtgcgaggcctccttccatagtgtgcattcagtccttctcaaagaatccattcatttccacattaaattctcaagtaaagaaatcaatcaaacaaaaaaactcccacatgtgttattatagtttctacctggactatgtggacatgtcctgtctgtctatagcagttgcaatgctattgcccagagtggaaaaaaagaaaaagaaaaggagcttcccataaggtttatttctacatgttaaaaactctattgctaaaaccctaccacactagcttaggaatcacatttttagtaaatgtcaccaacattttaaaaatttggggccatttttatcctctaagaaatctcgaagagatccagaattcatgtatttaaaatttgtctcatataacaaataaaagaaaaataaagacaatgaacagcttcacagacaaaaaaagaaagatactccaggtaaagccaaaacaatacaactttctaaaaataatatagaaaaacagctttatgacttgaaaataacactagccattagttattagtattagattgcaaaaatagctacaaatgtctctccttcctgaatctatgcccttgggcagtccacttccatatctatgctgggcttggccctgtgcctgtctttgaccaatcacaaattgctgcaatcaaaggcctcgaaagcactaggtcattgaggtttgccctcttttgctgctctcaggacatcatcttaccactgccatatgaaaaagcacaggttagttttcctggctgccaacctgccaactattagatatttatgagacatcatcctagatcatccaggctccagctgatgtagctcagatattagctgagccatcaaaagcagaactgtaaatcatgagctgaatcaatgtttgttgtatttagttcctatatatgggaagggtttgttatacagcaaaagctaactttgtagaaattggtacctagaaacggggtgctattataactaaacttaaaacacagtcatgtatcacttaatgatggagatactttctgagaaataggtcattaggtgacttccattttgtgcaaatataagaaagtatacttacacaaacctagatggtacaccctagtacacatctaggctatatggtataaacttttgcttctagactgcaaacttgtactgcatgtaactgtaactgaacactataggtagttgtcacaaaatggtaagtatttgtgtatttatacgtatctaaacataggaaaagtacaataaaaatgtgatataaacaataaaaaatggtatccttgcacttaccatgaatgggaattgctctgggtgaatcaacaaatgaatagtgagtgaatgtgaaggcctaggacattgctgtacactactgtagaatttataagtaggctaccctaaatttatttaaaaaatatatatcttcaataacaaatttaactttaggttactgtgacttttcaaactttacaaacattttaatttttaaaagcatttaaactcttgtaataacacagcttaaaacacattgtacagttgtacaaaaatattttctttcctcaattttataagctttcttaatttttaattttttttttttactttttaaacttttttgttaaaaaccataacataaacaccctcattggcctaggcctacacagaatcaggatccctattatgactgtcttccacttccacatcttgtcccactggaagaccttctagggaaataacttattcaaaagaagttgacaaagccataagaaaactgatttagctggctggaaaaagggaaaaatggtcacctgcagtaagttggagaatagacaacatgtcaaatgaacctacagaccttgacaagttggtttgtaggcagaattttccaagtgccatttggattattttgttgcctaagataaaggaagaaaagagagagagagagattagccaaagaaagatggcttattttgcaagtagaattcagaaagaataaggagggacaagaacttgctaggttggaaaataaatctattgctcatccccaatcttctgtttctaaaatattctaaaataaagtatgttctggggccagatgaaaagacatgttacatatacaaggcaaactataaagatgacagtagttttttcatcataaataatgcaagttagaagacaatagaacaaaatctttccaaatactgaaagaataaaaatatcaaactaaaattccttatccagtaaagatatatttcaaaaacaaagacaaaatagacatttttagatgtcaacagctgaaagacataacttactacaagaaatgttgaaaaaagtcattcaagcagcagaaaactgatgtcagtagaagcctagttctacacaaagaatgaagagcaatgaaagtagtaatcacatgagtaaataaaatatttgtctttattatttaaatatccttaagagataaccaattatttaaagcaaaaataatgatgatttgagtttttatcatatataaacataaaatgtatgaaaccaatcatacaaaaaccaggaacaaagaaatggaagtacactcttgtaagatattttttttgcacatgaagaaatataatatcatttaatgacagactgtgaaaagttaaagatgtttgctataaaccctaaagcaaacgctaaaataaaacaatcaaactttataattaatgtgatgcttaagtttatatgttaagtttatatgttaacttggctgggacataatatctagatatttggtcatactctattctagctgttctctgaaggtattcttgaatgggattaacatctaaatctttgagtaaagtagactgccttccataatatgagagttcatccaatcaattgaaagccttaagaaacagattgacctctcctgagagagaagaaattctgccataaactgtctttggatgtgaaccacaacaattgccaccccaccagtctaccctgcccatattggacctactaacctcacagacatgtaaatcagttccttaaaataaacttctatatatacatctatacacgttattgattgtttctctggagaaggctgactaatactactaataaaaatcaagatagaggctgggtgcaatggctcacgcctataatcccagcactttgagaagctgaggcaggcggatcatctgaagtcaggagtttgagaccagcctggccaacatggtgaaactctgtctctactaaaaatacaaaaattagctgagtgtggtggagggcacctgtaatcccagctacttgggaggctgaggcaggagaattgcttgaacccgggggcagaggttgcagtgaaccgagattgcactccagcctgggcaacagaacgagactccatctcaaaaaaacaaaaacaaaacaaaacccaaagcaaacaacaacaacaaaaacaaatagcaatgcaacatatgtaaacccaaccatatcaataattatctcatatgccaatgggataaatgccacaaataaaaggcaatgattgtcagactgataaaaagcaagagctaattatatgctaccaacctactttaaatatagagataaaaatatgttaaaaggctgaaaacattaaaccactctgtgttagtcaaaagacagttgaagtggcaaacattagacaaaatagatttcaaagcaaaaatattgtccataatgaagatatttcttaataaattcaagagcacagaataatcttaaatatttatagatctaataatatagattaaacatatatgaagcaaaatatgataaaattacaaagagaaatagatgcatcaaaatagagtcagaaatttcaacttccttatcacaatgtttgatagaattttagaaataaattcagtggtttataggacacttgagcagtactatccaccaacttgaatgaaataacccaaatgttgttgaggatgtaaacaaactaaaactttcatgtacatctaatgaaaagaaaaactagtagaagtatctcatagaatagttggcaatatcttaaaaagttaaaaaatataccaaccctgtgatttagacattgaaaatatacacatttacccaggggaaaagatagtaagtatttatacaaaaacctgtacatgaatgttaacagcagcattatttgtaacatctttaaactagaatcgtcctaaatgtccatttacaggtgaatggataaacaaattgttgtatatacctataatggaatagtactcagcaacacaaagaaatgaacaacagtgatacataaaacaacatgaatgaatctcaaaggattaagactaagtgaaacattcatattcttattttataaaattttagaaactgcaaattagtcatgctgagacaatgtagatcaatggctgtctgtgaatgagattggcaaggaagggaactaaggaaagattagaaacacaagggaatatttaacagtgatggatgttttattattttgattgtattgatgatttcatgaatgggtatattcatatgtaaaaactttcaaggtgtatactttaaagatgtgtggtttactgcagcagtccccaacctttgtggcaccagggaccagttttgtggaagacactttttccacggatggggtgggatgcttttgggatgattcaaccacattacatttatggtgtacttgatttctcttattattacattgtaatatataatgaaataattacacaactcaccataatgtagaatcagtgggagccctgagcttgttttcctgcaactagatgatcccatctgagggtgatgggagatagtgacagatcatcaggtactagattctcataaggagcacacaacctagatccctcatgatatggtttggctgtgtccccacccaaatctcatcttgaactgtaactcccacaattcccatgtgttgtgggagggacccagtgggaggtaattgagtcatgggagtgaatctttctcatgttgttctcataatagtgaataagtctcatgagatctgatggttttaaaaagtagatttcccctgcacaaagtctctctctttgcctgttgtcatccatgtaagacgtaacttgctcctccttgccttctgccatgattgtgaggcctccccacccatgtggaagtgtgagcccattaaacctctttttcttcccagtctcgggtatatctttatcagcaatgtgaagatggactgatacacctcacatgagcagttcacagtagggttcatgctcctatgagaatctaatgctgctgctgatttgataggagtcggagctcaggcagtaatgtgagcaattggaagtggctataaatacagctgaagctttgcttgcttgctggccactcacctcctgctgggtggcctggttcccagcaagctgtagaccagtatcagtcagttgtggcccaggagttggggacccctggcttactgtatgttaattatacctcaataaacttaataaaattatgtactctataattccacttatataaaagtaaatacagccaatagtaaactatattgtttatggatgcaaactttggatattgaactgtaaatcaaagcaaagtagggataaccttgaaagttaggatactgaataactctaagatggatggaaagatttatcattgggaataacatctggattctagtgaagttctatttctcgatctctgtgtgggttatgcgatatttgcctaacaaaaaattgtttaagctgcacctgtattcatgttgcataggcatataagtgtggcttagggcattcagagcagtctttacatgatctaacaacacaacactgacctgcacattctctaagtgggacatctgagtttcatttctttgaaatgttctttaaaatttttgagaaaaaggtgttaacaattctgccacaaagattaagactggatttggttaatcttcaggaaagcagaaacttgtttgtaactacttgaaaatccctttctggtatttgagctttgtgggacttttgcagtaatttacagcttgattttaaccgggttgaactttaatttaaccagttgattgtggcaagttatgataaacagcatgaaaaagaaaaaacaatttctttcataactgataatgtacacatgctgaggagaaagtgggactctgaattcttttggtgatcagccattaaatcataaagaagaggtgtcttctttatgggaagatagaatagaagcaagatcttcttaggtatgtgatcctgggcagatgactttattatacttctgtgaaatggtgcctcagcaaccacttatattttggctgtgaaaatcaagtggctataaatgtattaaaatacatccgaagcctatagccctaaataatgtagcaactctcaagttgcttttattaatatcagttttcatagttttcattctaatttgtcatagttttcattctaatttgtttgctgatttcttatcattattctcagtaatgcagtctttctctgaatcatagttagtattcttgacccagtgactcaagtcagcatgtctaatttcttaaatctgaattgtctgcaagatttcatcttgattctatcttttgggttgcgctcaagccagtgtaccaatttcacaatatctgctaattggtacattgttgcctaccatctttaaaatagcctgctctataactctagtttttttaaggaaatcaaaacaatgccattattataaaagttaatgacatagcaataacagatctattgtcacagtgcttatccactgcaagtgtccaatatatcttactaatttttcagagtttagtatttccactgttgaagttctttttatttttcataagatggttcacaatggacacagggctcaacattacagaagaaattgtatcagtctttaacatcttatccataaataatggcattgtaaatacacacacacacgtcaattataattgatataccctcatgcaaaagcattattaaaatctacaatattgatataataataccacctacatcattgagttctgaaaattcaatgagtgcatacatgcagaaagtttaaaataaagactaggaaaatgtgtcggatgttttcttctttgatcttaaagacagagataaaatgtacatattttcttagtcgaaatctaacttagtatatatctattaagttaatatttactctgactctcaaacattctgaatctcttagtggccaatcacttgtctaatgccacccagttggaaggagctaaaattgcttttttgttttttatttgcttgtttgttttttgagacagggtctcactctgttgcccgggctggagtgcgctggtgtgatcacagaactggtttttaaccacgttttgggtaataatacttcacaagaatgctggatgattaaatgaagtagtgtgtgtaatgtgttggctcattggacagaacactgggtgctgagggatcatataggagtctgactctgcctaactcttcaccttgtttaataataacactctggaaagctcatttatctatacatgcctttaaaagcagacaaagcatttttattgcttttttttttttttttaccacttccatggcctaaaagaatcacttttgttttgaagactctaatttgcagagtaaacaaaaaagatggaaataactaagaaataaaacctccaaaagtttaggaccccaaataaaaatcatttgaaatgcataaaaatgcataaaataggtacaatgaatagtaatagatggaaaaaaacagattccatcataggtttgttacttgaatactaaactttttcaataattagctgttataatatccgtgttcaaaaacacagcactcagtgcagatcaaaattctaaaataaacaacagttactttccattttctcttgagtaagttatgagattacctctattgctctaatctagaagatatgaaaacaggccctccggccctaactgactctgtgttgtgtaataatatttcccttcaccaacctttacaatgaatataaaaattcaatttcagacctacaagctagaaagggctcaagtgtcaccagacttttctaaggggatattttctgtttttgtctacatttatatttgactcatttagtggagggaggtaataggatttttctatctgctatagaagctatttcagaagtacacagatataaggtcagaaaatatattttaaaatcacaaaagaaaacaaaatgatatgttggttttgaaccctagggtctttcaacattataatcaagcatgcctgagaatatctagctgtgacttcagagagaataatagtacacccttgagtctactgcaacagtcttccatggtatggtaggaaaagaatcctaggatagctcccaagacttacaagatacacacctcctggtgtgtatgccctgcataatctctgggaatgtgaatttaatggattttcctctgcgattaagtaaagctatgtacactatacagttgatcttaagacagagaatttatccaggtgggtgcgacttaatcacatgagacctttaaaagtagagcattttatctggctgactgaagaagaggaaaccagaaacggaaagcaggaaaagaatttgcatcactcttgttggtttaaaggtagaggggatagagagcaaggaaagtgtgcagtactccaggagctaagagcagtccctggctgtgggtcggcagggaattaggaaactcagtaatatagccacagtcaactgaaatttgccaggaagaatgatcttagacgtggattttcctccaaagtctgcagaaaagaactcagctttgcctatacctggattttggttttgcagtttctttggaagataacacagtgatggtgtgctggacttgacctacacaattgttagctagtaaatcagtgtttttagcctctaagttggtgataatttgctacgcagcaatagaaaacaaattcacatggcttggatcctacccaaatagtttttattatttcattaattcatttgttcatctctatatttatttctgaacacattcattaagtgcctatcatgtcccttctctaatcgttatgacgagtttttaacatacaagacaattttatgaccctcaccttaaagactatgttatcaggatactggaatgtaacattatttactgttcctaaacattatcaaatacacatactgcagatactctgaaagttgtgaaagctttaaataattcagtatgcagttttgtggctcatatagaaagcttgatgggccttgtgaaaagctgtaggcattgcccatgtctaaaggataaaagcggtagatgacagtactccatgtaattattttggctgtctcacaggcttattgaaatttccttggagtgacatcaacaagatggctatctagaagctcctagcatccttctttctaccacacacacacacacagacacacacatacacacacacacacagacacacaaaaaagctatgaataatcaagtactttttgaccaaaataactaaaggagagctctagagaatagcaaagaagcagcagaaatcctgtagagcatagaaacccaggatggctgcatagggaagggaaaaagatacctcgcctccgccactccatcccctcagttggaatcagctcagaaccagggaggactcctttctgcagggaaaaataaagacgaccccagcaattctgattgccactgcagacacctgcagcctttgttatcagagactcctacagtcctcacaagctctaaactcaactgagagagctccctagagtcacatgctgagctatattcagagaaggtgacaacactgtgccctggcctcacttctccccactgccccctgtcccctatcctattgcctgtactgctactgcactacaccattttggaaccagagacactactagagtgcatcctgctctgggggtgaaacccattgcaccaccctccattcctgagagtttgctgctattgcaacatgcacactccatagtgtgccatacctgagccaagctgctactgtgccctactccctagggccaatctactatatagctgctccatcctgcccattctagttgctggggcacctccacttaaggccaacatccagtgatggtctgccagcaggggatttcagatattctgcacaccagagctatcaactgcacctcaccttctagcaccacaggtgaggcagcttcctgaacctagagactctaataactctggcataccagactagttgtttgccccagcatcacagctgatacagtgccctgctccccaggcatctggcagccccactaacccacatagccatgctttctggagctgagaagacatagtacctgaagtcccaggaaatcacaggagctgtgccactaccatctccaggacaaagagccacagttcctgcatacctgtaactggactaacctccacccatctgagctggtgagatgtcccacctttccagggaatgaagtcattgctgtgctgctccaccaccctcaatcccaggcccaagccacagtggtgccttgccattcctgagtacttgctgttactgtacccaggctcacagagcctgggcttctgtcatgtcccaccatcccagggtccaaactccacactatgtgctatctcatccctcagatcctgagctgcttctatgtcctgttggttccaggatctgaattgtagctgtgcactgttccgtgaggatttagtctctggaaaatcccttcttctccagagctgcaccagtgctgtaccctgtttcccagggtcagaacatagctatattacagcctcctgggtttaagctgctagagtttgtctcaaagcaatagatcccagctttttgggagaactgcatccacttgtgcctgggaatgtgaacctgtgtctcaagtcccaggtgttacagtaatttcacaggacgccccactgtgggggaagataagaacagaatgattcccaaagttcttgccataataacatacatagccaccattattgccacaaattcctgtagcctagaccaccaaggtaccaaggtatgtcagtcatcactgacactgatcacaattgaagaagctgcatacagactgtatcactgggcccacacagaactacagccactgcactttgcccaaccagtaccctcaggcccaccttcggtgaaagcctacaaaagctactctgtaaagtttggaagaggtaactacacaatcagatgtgcagacatcaatgcaggaacacaagaaacacagaaaacaaggaaacatgacatcaccaaaggagcacaataattctccagtaactgaccccaatgaaatggaaatttacaaattgcctgaagaggaattcataataatattctttattattaacaagacacaagagaatacacataggcgattcaatgaaatcaggaatataattcattatctgaatgagaaattcaacagagagatataataaaaaagaacagaaatcttatagctagtgaatttaatcaataaaataaagtttaaaaatacaatagaaagcttcaatagcagactagagcaaacaaaggaaagattctgtgaacttgaagataggtcatttgtgacttggtctgacttagaggaaacaaaagaaaaaggaatgaaaaagagtgaagatattctttgggacttatgggatatcattaagcaaataaatatttgcattatgagattttcaggacaagagattaaaaaagggacaaaaatgcttatttaataaaatagtggctgacaatttcccattttgggagagatatggacattcagattcacttagctccaaggtccccaaacatatataacccaaagaggttctctcaaaggcacattatagtaaaactgtcaaaacttaaagacaaagaattttaaaagcagcaagagaaaacatcaagtcacatacaagggaatctccattagaatatatcagtagatttctcaacagaaactttgcagacaaggagacaattggatgatatattcaacatgctgaaagaaaaacctttcagctatggctgttatacccggcagagctatccctcagaaataaaagaggcataaaatattatccagacaagcaaaagctaaatccatcaccactagacccatcctaaaagaagtgcttaaggaagtttttcaaaaaaaaaaaaagaaaagaaaaaaggcattataattactgtcataagtatatatgcaactataaaactcactagtggaagaaaatgcatagtcaagttcagaatactccagtactataatggtggtatgtaaattatacatctgcttagtatgaagattaaaagtcaaaatggtcaaaataactacagcactacagctacaataagttgttaagaaatatacaatatgaaaagatgtgtgacatcaaaaacataagttatagggggtggagagtaaaagtctagagtttttgtatgtgatagaagttaagctgttatcagcttaaaatagctgattaaaactataagatgttttatgtaagcctcatggtaactgcaaaacaaaaaacatggcagatatacaaacaataaaaagaaaggaataaaagcttaatactacagaaaattataccacaatgatagacaacaagagaggaagaaaggatcgacagagctacaaaacaactggaaaagaaataataaaatgacagtaagtccttacctctaaatgataacctagaatgtaaatagattcaatcctttaataaaaagatggagtggctgaatggataaagatacaatccaattacatgccgcttgtaagagacccataaaagacacatgtaactaaaagagagcaagagtggctacagttatgtttgataaatcagacttcaattaaaaaaactatcagaagagacaaagaaggtaattatttaatgatatagtggtctgacaatcaagaagacttaaaaattgcatatacatattgcatatatatatgctatatatatgctatatatatgctatatatgctatatatatgctatatatatgctatatatgctatatatatgctatatatatgctatatatatatgctacatatatgctatacatatgctacatatatgctatatatatgctacatatatgctatatatatgctatatatatatgcaatatatatatgcaatatatatatatgcacacacacacacgtctccaacattggaacacctgaatacacaatgtaaatagttataaacctgaagagcaaaatagaaatacaataatagtagggaactttaatactcttttcagtaatgaatagatcaaccagatagaaaataaatgaggatataatggactcaaattgcacttttgaccaaatggaccaaacagacatatacaaaactgtccatctaatagctgcagaatacacaacttttttcacacatggaacattctccaagatagaccatattttaggccacaaaacaaggttttaaaaatttaagaatatcgaaatcatacctagtattgtttcagaccacagtagaaattagtaaccaagggaatcttgaaaaattaacaaaaaacgttgttgtggaaattaaacaacatgcttaaacaacaaatgggttgaagaataaatcaaaagagaaattttaaaaatatcttgaagccgagcgtggtggctcacgcctgtaatccggcagtttgggaggccgaggcgggcggaccacgaggtcaggaggatcaagaccaccctggctaacacagtgaaaccccgtctctactaaaaatacaaaaaatttgccgggcgtggtggcaggcacctgtagtcccagctgctcaggaggctgaggcaggagaatggcgtgaatctgggaggcgtagcatgcagtgagcagagatcgctccactgcactccagcctgggctacagagtgagactctgcctcaaaaaaaaaaaaaaaaaaaaaaaatcttgagataaatgacaatgaaattacaacataccaaaacctatgggatgcagccaaaccatttctaagaggaaaatttattgcaataaatgcctacattaaaaaaagaagaaagatctcaaatagatagtctaacattatacctaaaggaactagaaaaagaagaagctacaccaacgattagcagaaggaaaggaataataaaaatcagaagtgaaataaataaaatagccacgtgcagtggctcacacctattattgcagtgggtcatacctataattctagtactttgggaggctaaggtgggtggaatgccctgagctcaggagttcaagaccagcctggggaacatggcaaaacctcatctttaccaaaaaaaaaaaaaaaaaaaaaaaaaaaaaaaaaaaaattagctgggtgtggtgtcatgtgcctgtagtcccagctacttgggagattgaggttgggaggatcacttgagcctgggaggtggaggctgccgtaagctgagattgtgttgcttcactccagcctgggcaacagagtgggaccctatctcaatgaaagagaaagaaagagagaaagagagggagagagagagagaaagagagagagagagagagagagagaggaaggaaggaaggaaggaaggaaggaaagaaggaaggaaggacggaaaatagagaacagaaaaaccatagaaagaatcgagaatatatttttgaaaacaacaaattcaatatggaggccatttgatttatgagaaaaaggaggaaattctaggaccatgctgaatgggctctgatgttgagtctgccattttctagctgtgtgactctaagcaagttatttaatatctaagccttatctataaactaaggatagtgattacttaattcccaaagtagttgtgatgatcaaatgatataaattcagtaaaatattaaaagtgatggggtaggatagtaactcaagtgtaatagtgatagtgatactaacggtgactaatattagtgagcaaacatgatgttcccaagactgcacaaattattttccatgctttatctctcatttcctatggtaagtgcatcagataggtactgttattttacccattttgcagataaaaaccaaggcacacagtaatccagtaatttgctcatggtcatgtaaataaatttgaacccaatttcttgttagcactctcttctccttataatgttctttttatcccttcagtaaaaataagtaaaaatattaatgtgtatgttttaccacactgctgtactttagcatacagtagacattgtgaacattttaaggtcataggctgaatttccttcatagaaaagaaagattactttctttcatatatatattctatatagctctttttcttctaaaaccacatatctacaaccagcttggaatatccttacctaatatctttgtttctttttctcctccttctcaaaatctttttctctactagctctttcttcattgtttattaaacatttcttgcccttaagaaagcaccttttgttatactctctttctacttgattgggtgtgtattaatcagtacatactaggttgctagtgtcagaaacttaatgtaacttaggaaaagtagaaatgtatttatttacggaataaaacaattaacaagaagagcaggtctatagttggataacggaaacaactggatcaaaatatatgaaagtcatagggaatggaaacctcatctctacctttttctgatactcgatttaattttctctgattgcagaccagcttcctctgtgtggtggtaaatctaactgacacaattctagagcctcataaatgaacagtttcttctaatggcaggagcagagtcgtgattctggttccaaaatttcccaagaagggttctgattggtctgatttgggtctgtatcccacatgcttgctgacaagtaggtagtggtaggtcaggtaaaatccatttagctcctactaaaggcatgaggatggagaatgtaggcaaaaggaagttttcagacatcaggaaaatactaagcagaaaatatcatagatgcttccttttttttttttttttttttttttttttttaaagaggcagggtctttctgtgttgctcagactgctcttgaactcctggagtaaagagatcttcccacctgggattcccaaagtgctagtattacaggaataagccactgcacctttctgccttctcctcttaaagttgctgttccctttaatactcttcttctattgactaaattttgccaagctttgtaactgttctgagaaatttctttgaatattatacttgtcatctgttatctcttcaccagatatttttctgtctttttttcttatatagaatttgaggtttgggttggatatttgaatatagcaatatttgaccatatttatgagaaattacttgaaactttctgctacattcagcatagagaagagttggtttataaagcatctggcttattggagaaattttttccttcagtttctttcccaataaatgccatttctgctaactcttgattagactacaaactgatctctgtaatacacagacaagtcctataaatctgtctttaatggttctcattcaattaaagtcttttcattgcttaaatctttctttcctcagagtagtagaaaaatttcaaactgaacggatttcaatttcatctccttacctggttcaatagtggtattttgaggttggctggctgctcaaaagaaatttttgttcttgaagtcatgtaaatgtactagggtatgtttaatgttgaccatatgagtcagtttttcctaaggcatgctgtgctttgacaatatatagattcaaatcatctactatttcaagaatttgaaatactactatttctgaattatgtttttaaataataattctgttccattatttctagtttcctttgggggggctttctttaatatattctttgcctgttctacattttaattactttttccgtctaataactttttaaaaatgagtttctttattgtcactttgttttgttgccttttaagtcctctatgcaccttgctgtatttttccttccttatatgtcttctaattttgcctttaccttttttgagttttatttcttttacttttatttcctgagatctgctagtttccatttcatgcatattgctgtttcaccatctctcttgtgtgcttttttatttctgtactatgttcttgctttacagaggcaactacttcaatgcattttactcatttgttttaaaatttatcacaaaatatttgaccatagttttcatctattttgttgcaacttgttttcttttcaggatactttgccatttgaccttcttatttttttttaatttattttccattatattattatatagatcctgttcttccttgcttcttgttttactgcttattatcaaaggacatgaattttccccactagctatttgtaagcagtttatatagggtgggttgggaggtaaaacagaaccatgcttagggctaaaaattactcaatatgaactaaaaatctgaaaaacctgaaaatactcactataagaaaacaatttcaaaagatattaaatatctgtaaaaagttttcaaagatatctggtttggtgagttagtgtttccaattatgttagtaagcagcagaactgggttttgaaacaaggggtatggatgtggattctgcaatgtttacccaggtataagaccaaatgaaactagcaagttaaacataaacaaaatgacagagccaattgatatccaactagtaacattcatttaatctgataaattctgctgttttgctgaaatgaaattgcccttcataaggtgaatatagatgagaattctgctccatatggaataaactcacatcattgtgagtttatatggttctgtcatcactgtgggctgtgtgctgagttaattctctcaccattttttaaacaactgtgaaaccttcctttgtagagttgcctttatgacatttatgacatttggccaagtcatttagaccaagtatgtcatttacacttatactttggtcatttagaccaaatatgtcatttacacgtaatgttagtcttctttattttctcattagctcatgtcagtataaatggaactacttgacaccaacataaacattagtgcaaagacaagtgtgaagaccctgtaatcacatggcacttttcagaaatatgaggtcatccagtgattctacaagaggggttggcaaactgcagcttgtaggccacatccagtttacccctatttccataagacccatgagttgagaatagtttttacaattttaattgttaaaaaaaaagaatatgcctcagagacatgtgtacttctcaaagtctaaaatacttagtatctggccctttaaaagaaaaaggctgctgatccctgtcctagaatatacttatgtcatttttaaaaatggttattatgagatgaaagcacaaaatgaaaagcatcttttagaaagcttcaggatacttgggaatactttttcagaaagcagggaagaaaacacatttctacctactgaaaaatgtgctcagtaactcatccccaatatttgtgagttaaaagcacaaacagaccattacgtgggagaggcacaacaattcttggcactaagattaaatagaaatcactcccaggattgtcataaagaagacactatggaagataacgatgtcttcactggcgcacctacagtacatctaacaagtttcacagggcccttttaaaagacaatttaaaatatagcctgatgacaacattcctaaaaacaatgtagtgaaggcagttttagagaacttgagagtatgggtcagagattttcatttctattaatctgactccatgcaaggctagattgtagactctggacatatgaagaaactggaaacccttaggacaaatctcttttttggtaaaactgttgaatatatgagtagataccctgctacacaactaaaggtcagcttttctatgttgccagctgaattcatcatacccatttcacattatcattacagaagagcgtgacaatgcaaaattctggagataagatcaaacatatgaataacaacatttaaggatgccatgaaggctatttgagacaggtcctctgtccatgtgatgcaaaaatgacagaggacacatcagacataatttgtcacaacccaatgacattcatgtcagtaggtgctgagatgtaatctgtcatgttttagttagaggaaactgtatgtagctcttttgatggattgataagtagattcatccatccttatactttgaaagaacataattattcataattatttgcatgtagttatttataaacacaaccctttacattttatcagtaaatgtcaagagttgcctcactcggtgcactttatgctagtttagctaatttgcttaaattgggatgcccagagcccaagtatatcctcttgtgtcctgggaaacccacccttgccctttgttaaaggagtagcagttccatacgctggatggattgaggaatttcccattattgattaaaggtcaactatactctgggttctattaaataggtacacatgaaattaattaagatgaactagttaagacaggttcaccatttggagccactctcccccatctccacctcatcatgcaaatcttttttatggaagctctattcagcttagatatttaaatcagctctcagtaacttatctaccataaccgtttacttagttgtcctctctcactctcagcaaaatcaatgagctaaaaagattaggaaccatcattctttgtatttccagcacccagcccagtgatggtgtgaggacacatctgttactccacaccttctattctcagcacaccttaagctaaaacaacttgtgtttctggcacagctatcggagactttcagaggtgacaaactcatgctcatttatttagttgcctaatttctccagtgtcagtaataatctatattcttagcaaatcattgggaattggaaaccactctgacagattaaggccaggaaattttttaaagaagaaatgcaagaactggaaattacatatgtgaccttgtgccattcagcctgtgaatggtgtgtgggcttaaaaggttgttagggttgggatggtagaatatgtagagcttttggagaatgttttttgttactgttgtttgacctacttcattcccttcagactccgagaggtcataacacacgatataaagtgcaaggttaataatggagaatgtcgcattcaggagtttctctgcctagatgtggaattctggcttataggctatttctttctgtgtgtctctttctcttcactcttgaaataagttaagaaattctcaacgactggaatatatgttttccaccttttctggccatcaactgcgttatcaggatgaatgtcaattactgtcattctggaagtcatagggtgcattatcctgttttcctattataggggtatttgagtaataaacttactctcttgtaatatcatataaaattttattttaactgacatctaaaagcacgaaacctcttaaagtttggcttgccccatggaggtgaatgcagctgcagctcatctcaggagtctgcccttatatgaactgcttgttcttacctttctactcctcagcatgttgaaactcagaccacactcctaaatgagacatccaaaggctccggcctgctggagtgctgacaagcatgctgtttagggcaggtactcagaggcaaagtcagagaaacatgatctcttcagcagcacgtttttgcacatgaaacctgtgtaaactcagcatgactcactcaggccaaggtgagcactctgatgtctgtgaacgactgcagcaacttggcaactggggccagtgtgcttccctgtagcactcagcagagacagttcaggacttgaaacaattttcctcattgctgttgtcactggagaacaaaaactgcaaaagcgagccattgttcacactgaaagtcattttgtggagaaaatgagaggcttggaccagtctttttgtcctttattgtatcgtcccctctggcatccatttatgggtctgatttcatttctattttcattttgagacttttctctatgacctcaggtcagagacaatatcaaaggcaatatgttttagtgggtttatttgtctgagtcaacagaaaaagagagagggaagggaaatggaagagtacagggcaggggggaggaaggggggagagagagagagagacagagagagaccaactgagactaaagctatgtctgtatgaaaagatgactatagttggatctggaattctgaatttgcaactaacactgatgccatttacaatgtaacaatcagctttagtcttccatgtgaatgtagatattatatcatcatctcataacattttattccatatacatggtcaccaagatgaacagaaagagttagatctgggtggtgagaactgggagaaaaccagccatgagaataagatggattgtcttttgtcacagaaatagcaaatttttaagtgtatttgaaatgataaatacttttttttaaccttttgtaacatttcacaaaacttttaaatcaaatttcaactggaactttggtctgctttccttaaatgcagctgatttcttgctaaattccattgcatttgatgccttcagggatttgggaagttagcgtactgggacagaggcattgatgatacatatgacgtggacaaaggaaatgaactcagcatatgtgggaagtatagcaagtgttcacttgtggccagtgtcaccaaaaatgccaccaaggtaactcaacatagtcaaagtaatgaggcagaattgttcttcagttaacttgttaatagggaaactttttataagcctaactggtctagtgatatttggtccagttctcaaacctatcttagaggcttccctgtctcatttccatagggaaaaaactccctatccaattattaaatggataaataagtgcttaaaacgtgaaaaatagggaaattcatgctatttgaactagtttttgcttaagtatgatatggccatggcaccaaacttcagtgtgtatttaggatcaccttagatgcatgttgaaactatacacatacagcctaagctaatcctaatgaacctgcttaagttggtcttgagtgtggcctaggaatttcattgtaaacaagtatcccagatgattctgatgcacatagatgcattctgatgtgtgtgtgcatgtgtgtgtgtgtgtgtgtgtgtgcgcgcgcgcacgcgtgcacgccagaggggagataagggaaagatttcaagttaaaaatgggtttgggttactttgtgaaagaagttgaatggcatgctaaggagtttgtgtttttaaataaagaacaaacgtgatcatatctgtactttgagaagtataactctggtgacaggacggtttgaagagggaggggagaggagtcaagaagactagttaagaagtttttcaaaagatgagcacttccgccaaattcttcatcacacattgtacaggtaataaataagacatggttcctttcatgaagttgcttatgatcttgtaggaaaagattcaatgaatgaggcagagatggagaagtcagagaagtggcttggatgggcaggttggggctggacagattttgcagagctttaagaagcaaaggaagagcagattcccagaaaagaatataccctaagagacaggccactaaattaaatgacagtttgatggtgccacttttttcccccactggggtgtctggactctacagacttacataaatgagcagtgagaaaatgtaagtacagattattgattacttttggggacatgtttgcgtaaagaaagacagagctaaaatagcagcttgaagatatcaaaggctaaggaaaggcaatttttgtgttgttttgcttttgttgtgagtctgttgttctttataggggagattggaatatatttccaggaaaaagggaaagaaaatccaaaacctagagaagtgaatgttggtggggcaaagagaaagagagcaggaatgagaccaggagggcaggtgaggtgaagaattcggtattgggaaggaagagaccagaaagctgaagaggatggatggctacacgatacctttgagactgggaggaagcagcaggagaaagagataaagaacaatgagagatatgagttagacactgggatatgagttagacactagtcacatttcaccaagggaagagtccaagcttaaacatatttttcatgtcgcaatatgcttagggaaagctggcccctttccgaatcccggaggatgaacacgtgattgatctaaacacggcatagctatcccattctcttctattggagttcggtttggggatgggcaagtgaccaactttaggccaaatattaaggagatttcttctgagggtacttctgggaagtatttgcttcatgatatatacatttcctcccttgaacttgatagtataaaggcataatgcttgggatgagggaaccatcttggaaccatgaggtgcaaacttaaggacctaagttaaatactaaggataggggaggagaagaaatctgagtctaatgataaccttgagacagtgtggtatctctgggactgcgtacctccaatttcttgtttgtgtgtgagtgtgtgtgtgtgtgtgtgtaatcaaacaataaagaatatatgtatgttctttcttgtttaaatcacaactattttaattttgtgatatttctgttaaaagtatatgtaagtgatgttggaaaaattggtctccatctttttattaaagaggtagtcatgtgcccagaaggatggaggcccacctgtgatttagggttgggatgtgtggaaaatacctgaagctaccattgaagatactgagaatggcaggaagctaatgaaataaatcaaagaaaggcagcataaacagacctcaaataaagtaggactggatgtggacagaatgactttgcaacattgccaaacctcaacaaaggggcaaaaaaggatagagtccttgttgaggagggtttaaaattggataccagaacacagcatcaacccaaagtcaaaggcacaaaggtgtcattgaggggagcaagggcagatttaaatgttttatgaaggagcaaaatcaggattaggattggatagtgcttggacaactcatacaatatgtttttgcctcagttttgtcattgctaaaaagtaaaattaacagctagtgcttaggtttttgtgagggtaaaatgggataatgtataatttattttacatggtatctaacatatttttaagaactcaacaaatgtggtaataattagatcctgaacttctgtcaaagccaggcaggggggcactaaagaagctcacacaacagaaataatgtcaaatataagtgcgacatatatatttttaaaatcagcaagatgtataaacaattctcactattaatactagtaagtttcttcaaagttgaacttaggaaacaggaaaaaattggcacagaacatcctgtgtatcttaccaagataaattccaaataaattgcctgctggcagtacccattaattatttgccgacaatttttcagccagcacatgcttttttatttagctggtccagcaagtcactgcagttgtagttgttcatcttgtcacaggactgggtagaaagccaaatgcagaggtatgagctgccaagtaacccactatctgtgcagctgtggggaggaaccagaaaacctcaagacttcttgctgcttccattttcctagttttttttctctagaacctcatccacatcgtatggtgctgggaagggtcccacagcgtcagtgtcttctatgagtttgttaaaaatgcagactcccaggtcccatcccaggagaactgaaacagaatttgccttttgataagatgtccagatgatttgtttgcacattaatgtttgagaaccactgatatttaggacttatctgaagccacctcacaggataggcagagaatcgctgtttcacccaaaggccctctcatttccttgtcatcccttcatgatgctggatgtggggttcttaagtgagacctcatcttcactaaatctctcattgctgtgcccactgaagccagccttcagttaccagggagcattgccttagaccactttaaccagagagcaacaagctcaaggaaattgtatgaactcaggtgctagacgttcctgggtttattctaggctctgcctcatattagttgacctgggacaaattaactcaactctgtgattgcacctctccctccaagcaagagcctctgcagccctttttcgtaactgttgacccttttctgatggccatcacaggtgggaccaagggagtacactaggggatattagaggaggatccctaatacaagattggccaataagctttgcttcctaggacatctggatttggaaatcagaatccactagttgcctttctcagtgtttgagcaaagaagaattataggacgacctggagaaattatttctcagcaatgggctcagagatacagaaaaaaacaaagacaatatggctgtagaaatatcagtcttcatttctgatagttttctaattttggatcctgctgtctactgaagtctgcattctgcttctgggttccatccctttattcatctaataatttatctctctctctcgcccacactaaattaaattccttaaatccacacagtcctgacaaagcaataagctttaatgaatggtagttaaaatgattattattgctactactggctgatcaacttaatcattattattgtaatgcctcctatatcagctgttttttcattcaaacatagtcactgataattgatcctcaaaatggtaagaaaaccaatcatctgaatcactaggaaaaataaggaaatactattttcatatatgtttatgtattcactattgcattgatgttcaaataattaatttaaaatagaatgatgtctaccataattatagagcacagtggcagctgtcatttaagagcacattttaggcctgaacccctgcaccactgagggaaggaattgtctcagccttcaagcctatcgtgtcccatgttattactcagatatcacaggagacctaactgacatcaggaaggtaaactcagtgacccaggaaacaaaactgttaagttataaaatgatgttaagaatccttgattccacttgctgctgtgggtctcatataatatactcccctccaagcccacagagccttatctcagctggcagcgatctggaaacctacctgttacattaatcaaaacatcttactggaatgctaacttcttgcaaagttccagctcttttcatcaaaaccaattatgtatgaaatgttagacattgtccagtggaagatatatattatcaatattaatgataaaaatcacaactaacatttagacggtagcatgtatcacacccctttgaaaaacgcaacagtattttcagctagtcatcattttctacggttttgtagtgagacatgtgagacttttaagaggtcaaataactttctcaaggttcccagtttgcctgttgcaaattacacttctctgacacatatggatagctctgtccagtgaacactcttagaaacctttaagtaggctgggagtggtagctcatgtctgtaatcccagcacttttggaggccaaggtggatggatcatctgaggtcaggagttcaagaccagcctggccaacatggcgaaactccgtctctactaaaaaaaaatacaaaaattagtcaggcatggtggtgcacacctgtagtcccagctacttggggaggctgaggcaggagaatcacttgaacttgggaggcagaggttccagtgatccgagattgcacccctgcactccagcctgggcaacagagtaagactccatctcaaaaaaaaaaaaaaaaacctttaagtagaaggcagagcctttctcaacatgctacaccattaaaatgtcacatgttccttttttgagaggtagggagaacactttagggagaaattgtctcttcttcagagatgtggctggcaaaaaagcaaagggaagtcgggacactttccaaaaaagcaagctacgtagggcgcagactgcgggcaagacaaaagacctctccagccatcctgaaacattaaacccaatttccttatccccagcaggtatctggcacaactcgcatcattacaattttctagtgtactgagctggggaaatgtttccaaaggaaactgagtagttaccaaaggaagagttgaagacactttgccaattctcttttcttaaggacttagtaactcagactttttaaggtaggaaagattttgccttttgaaaataactagagtttttgctaccttgacaattttaagcaacactgaaagaaccgtggaggttgtataaaccatttgaatttttccgtcatagacctaataatcaggactctggaatggatttcatcttttcttatcaaaagggctgctctcatgctcaatcagctattctgtttcttttcaaaaccgattttgtgttagccatggggagtcaggcagtggattgtctaaatacttttatacagaaacaaaaattcatgcttgatgttcaggtcagttttacagagttgtaatttagaggcattcaagggagtttaatggagaaggaaaccagtcaatattttattcaatccaaacatgaaccaacattattaagtcgaggaatctttctgctgagaaaataatgtcacaaaggttcagtcaatctctgggagaggaaggagggttcataaaagactgcacagtttacatgtgttgtgggaatttaaattttagtaattcttgatgcagaattggacctgtggaattagtcccattttacctccataggaagtgttcaagccagctttctaagcagatttcaaattctgcgtttaattacatttcctaaaacccttagtttgcacacacagcccatgctactctggctccgatgtccttttcagttgctggttggcccttcttcatcaggagccctgttctcgactaaaacccagctccacgctgctcccatcctgctaggcatggtcatgatcatcccaatgcctgcaatgccccctctctgtccagggaatgctttctgatctttaaattcctgaatcaaatatcaccttcccccttttcgctcctcttatgctgcctaacaagcttaattattcttatttctctgttttacctttgctatcaccttattgccatttatcatggtggctcattttaccttttttttttcttttccttgattacaagctctttgaggatcttttttttttttctttcctgcctggtcagtgttcaatacttactgagtgactgaataaatatatatattagataatgcaattactatggattttaaaatctaagatcaaattattacatttgttgtataatcagatattttctttgaaaagttattctttctccaaccagtaactcctctgagcaagtggtgcaagcactgcctaacttcttgagcgtagagtatgaggagaaggagcagttgggtacccacaattgtcaggataccaataatctgaattgtgggtaaaaaaattattctttagagctatgcttttggattcatggcaagttgatgttcacagggttaactgaaaataaatgtctactgctgttgtgcactgtaaattgggtgcaagttatatggcctccactgttcaagatatatgatgagtcgatttctaatgattgcaatacctcatgagataccttacccactcagttttagagataggaaatttgaggttcagaggtgtcaaaatgatgtctccaataccaaatagctaagtaaatgttgaaactaaaaggggagccccctgccaaagacatcctatgagtagcaatagaatagccagaagggcagagtattggggtggtggtggtggtatcagttctcatgattttaacccaaaatgacagtctaagaaggaaagttagcatagaatattctggtagatatcatgaaactcccactccaacttatcagaagaaaagcagcccttttcagaagcagccgactctagcccttggtatgtcttgtcagtggactggctcagatctcataatagtgccatcccttgggggactttttggaagctgcaaacctcccgacagaagcgctgtctaatgagagcctcattcctccaagtgctaagggcaagagtctgggcagaaggatgtgtgtagtgctgttgtgagagaactggttggtactgacacctgaaaaatctccactagcttttctgcaaattataacattaatatgcttgagttcagccattgggaaattaaacctaatgtactatagataaaagattgtaggccttattcaaaataagattcagaattaaagaagactatgcatggtacctccagaaacactatgtataatattaagtattccagaataatcataagaatgcaactaacatttttggatatttacatgtgacaggcactatgctagtcattctatatatattatctcttttttttttttttttttttttgagatggagttgactcaccacaacctctgcctcctgagttcaagcgattctcctgcctcagccttctgagtagctggggttacaggcatgcaccaccacatacagctaattttgtatttttagtagagacagggtttctccatgttggtcaggctggttttgaactctcgacctcccaaagtgctgggattacaggcgtgagccacagcgcctggccttatgttatctcacttaatcctcacaaagaacttatgatatacacaaacactatcattatctcgttttacggatgagataacaaagttacactgttaataactaacagaactagcacacaaactatattatgctgatctactcattttccattcaaattaattgaggactgaagacccaaagatgaagggacacaacatctgctcccacagtatgatagggaaatgaataaaacaaaccaattgttcaatggaactatggcactatggcataagagagaggcagaaatggtctggtaggctaggggtgggcaggggggatttcggagctatctgagacttggaataataaaaggagtttctaaggtagaagaatcaaattataaaactggcaaaagaacatagcatatgctcagagaatgatgggttgttatagtttgaatggatgaggtccctccaaaattcatatgttggacctgaataatcaatgtgataatattaagagatgtggccttttgagaagtgattatgtcatgagtgcttcgcctcattaatgggattagtgctgttacatgagaggttgaaggaagcactctaggaccttcagctcttccaccccttctaccatgtgaggacacagcattcatcccttctggaggatgcacttccaaagtgccgccttggaagcagagagcaagcccttaccagacactgaatgtcagagccttgatcttggacttgccagcctccagaactgtgataaataaatttctattattgataagttacctagtctcaggcattttgttatagcaccaggaactgctggtaccaagcagtggggtgttgctgttaacaaatatataaaattgtggaacaagataatgcagagaggctggtagattttggaaccgaatgctagaaaaagtctctattcctgtgaataaagcattaaggcagttctggtgataactcaaaagagaacagctgtaggggaagccttaatcttacagactacttaagtggttgtgatcagaatgctgatacaaatatggatggtaaaggcaattctgatgaggccttagatggaaatgaggaacgagggattgtaaactggagaaaaagccatcctgtttataaagtggcaaataacttggctgaattgtctgtgtcttagtgcttagtcagaagctgtgagcaatgaactagagtatttggtggaagaaactgctaagcaaaatattgagggtatggaacagcttctcttgactgcgtatagaaaactgtgtgtgagagaaacaaattaaagatggaatttatactcaaaaggcaaaaagaactcaaaagatttggaaaattcccagcctggccagattgtaaagaataaaaaggtgtgttcaggagggaacaccagggtgtgatcaagtgatatttgataagattagtgtggatagaaggaagccagatgcaattcagcaagacaatggaagaatgaccctgaaggcatttcagagagctttgagggtgctcctcccatcacaggcccagaatgccagggccttgagagcagaatgggttcaaaggatgggggccaaggtccctgtgggactttgaggcttactacccagggccaactcaatttctgctccacccattccagtgcagtgctctttggctgctccagcatggctcaaacaggtacaggtttaatgcaggacactgctccagaaagcacaggcagtaaatcttggcagcacccacctggtgctaactgctggtgcacagagtgcccaagctgtggaggcatagctacctccacctaggtttcaaaggatgccttggagagcctcatagcccaagcagagaactgccacagtggtggggccacctcacagagcctctactagggtaatgcctgatagagctatggagtattccacccatgagagctgctgtgagggctgtgcccaactaagccatggacgggtcttccctgggttttgggtcccaacccccactcagtatgtcaagaaggcaggacatggagtcaaagaagattattatcacgcctcagaggtgaatgtcgtttgccttgtcgggtttaaatttacttgtgaattattacccctttcttctttcctatttctcccttttgtgatggaaatacctgccctgtgcttgttccacccttgtattttgtaagcatttaacttgctggatgtcacagattcacagctggacaacaatttgcttcagaatgaattgtaccttgagtctcatccatatccgagttagatcatatttacaggagactctggacattatttttattttttccttaaatagtgtttgaggtacaggtggttttttgttacatggataagctcttttgtggtgatttctgagattttggtgcacctgttacctgagcagtgtacactgtactcaatatgtagcctttgatctctcaccccctcccaccctttccccacaagcccccaaagtccattgtatcactcttgtgcctttgcctcctcatagcttagctcccatttataagtgagaacatacaatatttggtttgccatttctgagttactttacctagaaaaatggcctccaactccattcaaattgctgcaaaagacatttttcattccattttagggctgagtagtatttcatggtgtgtgtgtatgtgtgtgtgtgtgtgtatctatgtatctctctctctctctcacacacacacattttctttatccacttgtttgatgggcacttacggttccacatctttgcaactgcaaattgtgctgctataaacatgcgtgtgcatgtgtctttttcatagagaattcatgactaagacccccaaatcaaatgcaacaaaaataaaaataaataaatgggatctcattaaactaaaaagcttctacacagcaaaagaaattatcagcaaagtaaacagaaaacccacagagtgggagaaaatatttggaaactatacatccaataaaggactaatatccagaatctacaagaaactcaaacaaatcagcaagaaaaaaacaaataatcccatcaaaaagcaggccaaggacatgaatagacaattctcaaaagaaaatatacaaacaaatggccaacacacatatggaaacatattcaacatcactaattatcagggaaatgcagactaaaaccacaatgagataccaccttactcttgcaagaatggccataattaagaagtcaaaaaacaatagatgttggttggtgaggattggtgaaaagggaatacttttacacagctggtgggaatgtaaactagcataaccactgtggaaaacaatacgaagattccttagagaacttaaggtagaactaccattcaatccagcaatcccaccactgggtatctacccagaggaaaggagtcattttgtgataaaagagactctgaactttagaattttgagttgtcgctggaacaagttacaatctttgaggctactgggatacaaagaaacaatgcatttcgcatgtgagaaaaacatgaattttcacggggccaggggtggaatattattgtttgaatatatatgttcctccaaaatttatatgtcagaacctaatacccagtgtgttggtattaagaggtgggaccttttgagaagtgattaagtcatgagtggtccaccctcaggaatagggttactactctcataaaagaggttgaaaggagtgccctaggccctttttcccttctatgtcttctaccatgggatgacacataatttttcccctccggaggatgcagcaacaaggtaccttcttaaaaatagatagagagcagcgttcaccagacacttgatctgccagtgctttgatcttcaacttcccagcctctagaactgtatagtctgttcctgctgctataacaaaatactttagactgagtaatttataaacaatagaaataaattatggtttacccagtctaaagtattttgttatagcatcaggaacagactgaaaaatggatactatgtcctgtatgactggcgcatagaatgtgaaacagagagtgacagggcatcagagtggaatatgggaaaaggccaaatcctgaaggtccttgtatgtaatgcaaatgaaataaaattttatttaaataaaaggatagggagccattgaagaatgtaagtagagttggtatcaatagcgttgctatttatgatgatcatgttatggagtgaatgagtgtgtgtgtcccctaacagtcataggttgaaattctaacccccaatgtgctggggttatgaagtgggacctttgggaggtcattaggtcatgagggtgtagccctcatgaatgggattagtgcagttataaaaagacacaagaaagcttgctttctctctctgctcttcaccacatgaggctacaaggagaagcaaacaatctgaaccaggaagcaggttcttaccagacataggatctgctggaaacttgatcttggatttctcagcctccagaactatgatcaataaatttgttgtttaagccacccactccatagtattcttttatagcagtccaaacttacaaaaatatatcactttgatggagtgtagtgaatggactgataatggtgagactagaaataaggaagctaatggagatattgcaatagtcaaagccttaaaattgagtgggaggagtcggaatggaaagcaaataataaattccagagtatgggtagcatagaatagtggctaagaatatggcttctgggctggctacttaagcttgaaccccagcactgctacctcctagctatgtgttctttgggaacaccattagcttctgtgtttgagtttcctcatctataaaattcataataatggtatctacctcatagtgttgttgtgtatattaacatgacatttgaacatgttgctgaatattaccgtacagttatgcactttatgtgatgtgcctaagtgtctagcacaaagacagcattatgccagaggcatttgtgtctgtgtgtgtgtatgtgtgtatacaatctatatatactttttgctcatcacaatgggcaaaattatttttgttataaaattgtattctaaagtaaatttaatttacttaaaattatattcaggacaagtaggcacaaaaattagcctggtttagaatgacaaatatgtataaaaattaaaaatgtgattctttaggccaggcgtggtagctcatgcctgtaatcccagcactttgggaggctgaggcgggcagattatgaggtcgagaaatcaagaccatcctggccaacatggtgaaaccccatctctactaaaaatacaaaaattagccgggcgtggtggcatgtgcctgtagtctcagctatttaggaggctgaggcaggaaaatcgcttgaaccctggaggcagaggttgcagtgagccgagattgcacttctgcactccagactagcaacagagcgagactccatctcaaaaaaaatgtgattcttcgacatttatgtttttgaggtccttttaaagtcctatagttgcatggtataatgactttggagatagaatgtttcagaataggtaacattaaaggattgtcccatgtaactggattctcataattgcttttttctttttattactacttaatacatatcctagataacccagataacttggttttgaagaactactaaaacacaattaagtattatcttttaccctaaatgtggttagactctctgtttaaaattattgatttttggatcccatatgctctggaaattttagtgtgttttaaagcaaaatataagagaatgtgaaccgagggatattttactctttacagcatgttgaacccaaactctcactagtatctcatcgtatttcccaaaggtttgccaggataaacttcagaagcagacagggtgccttggctcaaggatttgagaaatttggtcttactgagagaaaatagagtgagtaaataattattttcaataaaggattgacctggtcaattttacgttttttttttttttttttttttttgtaagatctgatgttgggatgaggaatagattgatcagaagatagttgtatggagacaattagaacattcctaactacttcataagagagatgatgtaggcatgagttatggcatgtaggactggacttaagaggaagagaaagaactgagaaagtggtagaaaaaaatctcatagaacttgatggctgattgaatttgaatgactagggaaaagaaggagtcaagaatgatcccacatttctaggctgtgtaaccaggtagaggatcatgagccccaactgacagagaatgtggaagaaaatgtagctttggggtatggagaacagaacgtttagttttggacatactgaatttcaaaggtctatgccagagctaggcaggcatgaccagcagataatgggacacacagctccagtgagaggtgtgggctggagatactaatttgagatttattaccagaggtgggagatgagtcatgaacatgggtgtgctcttcttaggagaatgcaaattgcagagaataattggtcaagaacagaaccctaaggaacagaagtgcgtaaagaatttgtgtagaaatgaaacccttgaagatgaaagaattctggattagacatgtaggaagaacaccacggaaaccaagggagttgacaatagttttggggtagaagggatctattttatgttgtgaaatgtccaattagataaatactaaaaagtttccattacgtttttaaaatagcagactttttttttttttgaaaaccctcttattcagaacaggttcagtggaatgttaggggtagaagccatattgaagacagctgagaaactaatcctaggtaaagatgtggaaattgcaagacctcactttcaaaaagttttgaggagaagaggagaatggcaatactactgtagagcatactttgggaaactctgggaccacctgggtcatactttgggaccaggagaggcatgtgcctatttattggctgagaggaaggagcttatagaaagtgagcagtttaagataccatagagactccggccattgtggctcacgtctgtagtcccagcactttgggaggcaaaggtgcaaggattgcttgagcctaggagtttgagactagcctgggcagcatagtgagacccccatctctaaaattttttttttttttccaaaatttagccagacatggtggcacacacctgtagtcctagctactcgggaggttgaggtgggaggatgcttgtgtccaggaggtcaagtctgcagtgcgacatgatcatgccactgtactgcactccagcctggacaacagagtgagaccttgtctcaaaacaaacaaacaaacaaacaaacaaacaaaaatacaaaagagagagtgatggctaaaggaaaatgtatgggaatgaagaacattctagtactcaggtgccttaactttgacccagaagaaatttttttgtaatgagagcctggaagaaaagagcaaaagaagtaatggatactatcattgatagaactttcagcagagacgcagaaatttgtggcttataacattagatggcatcaatattccccctgagataggaaacaaggtcttctaaaagtgagaaggacagattatttaatacaggggctaaagagaagccccttcctcttgaataaagcctgtgatagatgatcttcaaagaggaccaccatcaacttcttcttcccctggaagcacacactgccacatcccacatcaagaggtgggatttgtttccccttctcttgaagctgggaagacgtgttattgcctttgatcaacagaatacagcagaaataatgttatgccagttccaggcctagctttctaagcatagtggagttccccttcttctctcttagaagccagctaccatgaataagaaattcaactactctgagatcaccaggctgtgagaaaagctaagctagctgaattaatttgctaggactgccatgacaaaataccacggactgggtggctgaaacaccaggaatttattttctcacagctctaagagcaaggcatggacgggattgcttttcactgaggtctctccccttgacttgcagatgactagcctcttgttgcctcttcacatgggaatgcacgtctctctgggaatgcacatccctggtgtctctttctcttcttatgaagacgcaagtcataccagattagatctcatcctaaaggccttatttaacttaaatgtctctttgaaaccatttttccaaacatggttacagtctgaggtactggatgttgggacttcaacatatgaattttgaggatgcagaattcagcatccaacactaaccatgtacagagatcatgagagagagggacaggacagatgggcaatgtggagattcattggtcagtattctgagcttatattttctcacataatcatccttcacataagtctctttaagcacatagagcaaagctgtatcaatttcatgctgcagttacacctttctatttagaattcacaaaacaaaattacccatccccctcaaaaaaaaaaaaaaacaaagaaaataacacatatacatcttctgatggaactaaatctgatatgtaaaatgactcaagaaaaatccccagctagtgagactgtgctactctctattagggtaataaaataacctgctaatatcactggcttctgatacaattgtgatgtgtaatatataggctgggagaccactgtggatatctatttttctctcatttttccttatataatttgggaagtggaaggaattggaaactacaatttcctcatgccttcataatagattctgtacatcctttggaaagtccacaaatctaaaactttaaaaagctacagggatcaggcgcggtggctcaagcctgtaatcccagcactttgggaggccgaggcgggtggatcccaaggtcaggagatcgagactatcctggccaacatggtgaaaccctgtctctactaaaaatacaaagattagctgggtgtggcagtgtgtgcctgtaatcccagctgctcaggagtctgaggcaggagaatcacgtgaaccagggagttggaggttgcagtgacccgagatcgtgccactgcactccagcctggcgacagagcaagactccgtctaaaacaaagaaacaaacaaaagctacgggaagtaaaatgttgtcagtttaattctatgagaaggtccatattgtgataagggaataatattaagtcatgtacagaaggctgatactcagatacaatagtgaccatctacattgcagggtggatttgaagctgtccatttcatcccatcctctgcaatggaatgggaactccaacaccttctccaaagctgagtcgctcactcattctctgttattctcttggttttctaagcagactgtgttccagtttccatttcattctgtattttcttatgcacattgtttgttgaatttttatatccacacagaaatgcacatccctacctccatacctacacacataaaagatttttgatgtatggatgctggatgcaaggactaaagaatcaaaagcccttggaataagagagtactgagagataggacaaacacattttttcaatgttcagacttgctggaaaggagaaaataccctaaagaaagtgtcagaaacccccctttaggcctcttttgttactctctctagcttttcaattggggacgtcagttttgctggtgatggcataggcagggcaaggcaaaattaatataaaattagagaagatacgctataaaccggcagaggtccatctttaaaccattgtgaacaggcaggggttcatctttaaaccattgtgaagtgtgtcttctctaagtttaagacgaaggtccagtcttctccagtggggccagaagcacaagtccttttattttttattttatttttttttttgagacggagtctcactctgtcgcccaggctggagtgcagtggtatgatctcagctcactgaaatctctgccacccgggttcatgccattctcttgcctcagtctcctgagtagctgggactataggcgcctgccaccatgcctggctaattttttgtatttttagtagagacagggtttcaccatgttagccaggatggtctcaatcttctgaccttgtgatctgcccgcctcagcctcccaaagtgttgggattacaggcgtgagccaccgcgcctggcccagaagcacacattgtaagagattctgccttctttgctttcaggccacaaaaataagaggtggggcctggtccttgtaggatttttttctataatatacttttagtttagctagtattatatttctgtgtacaatccatttctgttattaccatggttactactattgtttattatccttgataatcactagcttgaaccactgcgataagtttgaagctgatttaatagcctctactctcattcctctcactctgctctgtcagagtgatatttcttaaacatcaatgtgaccatatctgtggcttgtcctttcggtgatctcatccagtctcacggagataagtatgatatagatgttggtgtcatcagtatttatttcccagcctggacctctcctctgaactctagatttatatatatgcaactacttactccatagctctcttcggatgtctaagagacatcctaactctccaagcaagatgaggctcctgatcttcctctctaaatgtcatcctccctccctcagttctcctttcccatttcagaatgtcaatccattcttctgaatgctttagtcaaaaaggtcagagtcatctctgaataggaactgagatacataggctaaatgacatcatggcatcctcattacatgagtcagtaagtagcagcatcaggatatttactcggacagtgtaactccagagtctttgttctttacccctatgtttgactgcttctctaccttataaatccctttacaggtaatccaaaaacttcatatagaatctaaatgacaaatgccaactgctaacctcaaggcaagcttgctacatcaaagaactatgaattctggtctacctagctgtctgggaaaagagctgaaaattcccttggttgagggccaagatcttttgattcatttttctctctctttcttataccttctgcatgttcttatgggaatcctagattctgcatgttcttatgggaatcctaggctgtgattttgagatgggaattcagaagtttctgttataattctgtctcagctactaattagctatatggccttgggaagtttctaaactttttggtattttataattactctgccaaaaaatgacatgcatacactagatggcccagagtctatagcaataatacagaaaaaatgtatagagaaatagataaatcaaattacagggcctgtttgcttcttgagggaaagaatcacaagtttgtttactatccatctcccaagtgcttattgaagttacatcttcggcagaaactcagtaggtatgtgtgaattgctggttgaagattcatgatttgctatatggtacggacaagatgccttagaattccagaggcagtttggaatagtagaaacaaatctgaattgagaggcagacaacaggatctaatagcagagaaggcagagatgtgtaagttagttgacttcaggacaaacatctatcatatagtcaagacttttagtatttgcctctgtaaaatataaagagagtgggattggttgatctcaaagatatcttaagggagctgtgactgtataatttactttttccataaaacctaaaaagtgtaagcatgaaacatttttgtgtgtgtatctattccattggaagggctcagcaattgagcatcaggatctagcacatataatcatctgtttacatttcatttattttagaccccacaccaatactgtgaagtggataataatatctccatttatgcataaggaaattgaggtccagggaggcttttcaaggtaaaactcagtgtcagagctgggattgcaatccaggattaagtggctctcagtttcaattctctttgcattgaaccacacatcctccccaagtctctggcactagtgatgcacatcaggaggcaatgtaggggctcttcaggatataaagagggctcatgggtacaaacatacagtgaaaaggacatggccacacttcttgaaaaccaggttcatccaactctaacagaaagtgctatgattagccaaaaaatatattctagtcacacacacacaaaactaattaattagaaaaatctggtgattaactgcatgccttcattgttttcaataaatgtaacctgtccaataaatcagtaacatttattaatgataatacaaagtatattcagtaataggcttgccttccatgaggagactaatatggggttttatatggagtcccaaaagaaaccaaataaacattgttagcatttgcttcattgcacagattacatggtgccttgattctgctgctgacaagcagtaaattgctctgttgtgtgtggtgcttaaaacaggtttaatctgctattattaatagttccatgaagaatatgattgcctatccccatcccactttcaaccactgtggccaacatacgggaactcaggcaactaaaataattacagaccacaagctgtaacaataaaccacaaaaggactaatcatatcctttcttggaatttacttatttcaaatagtttgttactttttttttcatgaagagctccatattggaccacaattgtgatgagaagatctaacttggatttcagctgcagaaattatgctatttactttcttattacaggcactaaattgctgtttggattattattatttttttcctttctctagatagttcaacaaatagattttacggtctctttatgggacaaagcagagtatgatttcgaaaagtataaagactaaataactagataattgcctagagttgaagtggtgtattcaggaacttcactgggaggaactaaaaataatttaaaaataggagaaagtgtcattggcccatttatgcaaagccaatgcaaagaaaagctgaacacttgacttctgagaaattaaagacaaactgtggtgccaagttacagcaattcccttggcctaatttttggtaaatttaattttatcctttctcaatgttgtggaatctataatgtatattttattggtcatattatatgcatgtctcatgcaggtttccttcagaacttcttgaagatcaatagggaatatattaaaaatgaaaatagaaattaggttgaatattggcctacctacaatggttgaaaaatcactttagaaaaaagtggttttgcttatttccttgttgacctatttgaatgctttttatttaaaaaaaaaaaaaaaggtcctcagcatgaaggatttggtaggtgatgttttatctcactgtaaacatttctttttgctaatcaaggatctttgaatgacagaagggattttaaggaagacaacaagttagtcttctggagtaacattatctgctctagtgaactggtcctttggagttcggtggttttaaaggcatgctttcttttattatttggagattatattgtttaaagttttctgcatggtgaatagaggttgctaggggaacataaaactctacacagagacagaactatgactaggtccaggctctgtcaccaaatagcttgtgatgctgagtcagtctcacaaatgtgcagcctgttgtttcctcttccacaaaatgataatatttctcttcatgtggctttggcagtgatatgacctattacatgtgaaggcattttatgataacgtgcggtgcacattagacatcaaactttgttaacatattaataatatacctcatttggtgacattgttctttttcctttataatttttcaatgataattattaaaatctttgtcatcaacttagtgaaaccccgtctctactaaaaatacaaaaatcagctgggtgtggtggcacatgcctgtagtcccagctactcaggaggctgaggcaggagaatcacttaaacccgggaggcggagattgcagtgcgccgacattgtgccactgcactccagcctgggcaacagagtgagaccccatctcaataataataataataataatactttaaaaaaatctttacgggtcatatgtgccccctcccagttcaccaactttgccttctcactggatggttctcataacttaactctatttccacctacttttctaacacggtatttcataccatacaaattggtcctttacgcaaaataatttatatgttaatgacttggtcagatgggctcaatattaactttttcctcgaaggtgctagtttgttatcccacacacagtgcagttaatacactcataaatgtccttcaaaaatgtttctaagggccctgcagactgaattttagactccgtgctcatttttacttcagtaatttcattagtagtgtttattttataaatagtttgtaaagtgtttgaaggcagaaacatttttaaaatgtttatatatttttgttccaaagtattttgcagagaaacaaatccacagaagcacccctaaactgggagtgtggtgaagtggggaagagcccagcccagggctgcagatctcgggatccaagaatacatagcaggtagctcaagagggaatttagagtctaggcctgcatagaattcacctgaaaaggtggaacagagaccaggactgaaaccaggaccaaaacaaggaccaaacaaaccagatattccagagaagagtaagtggtttctattggtaagagttgggattagcagaaatttcctgaaacccagatgtagtcacagaagccctagagatcccatggccctgcctaagtgaaattagggagagggctcagtggggtgtcttgaatacatttacttgttcaggtgtcgaataatgcctattgagaagcaactatgtgccaggaaaagtacagggtactgggtatatgtgggtaagccagacagcagcaactctgccctcatttacctcccatctcagaaaacaataaacaaattcattaattattagagataatgataaatgctaagtaaggaacaaactggacacagcaggggtttcacctacatggagctgtgattaggggagatgatgtttaagatgacattggaagcatgagaaggaaccaaaaggtcctcagaccaggagaggccaaaagctcttctccatgagtgatttaaagtaaatgtacataaagagtagccagtggaggagatggttgttagcaccgtgatggaaaggtattgggaaatgctggaaaagcatggcataagggcaagaagggaaggtcacccaaaggcaaggttcttgtgggcttcccaaacctcctctgcttctctgcaggtgccagaatttggttatttctctgggaagaacttgtgtcatgaaattgaaagaagcccaagagagttgcgccatagagaatgaggagtgtttgtcagatatatagttgtcatttactgaatattgtggttctcatcttagtttactcccaagaaaatacctggaggctttcaggtgcttctctcttacgaggcctggtactaatgttttcattcaattctttgagcttccctagattcttttaggaacttcttttttttctcctgttagatcaagattctgttgcttaccatcaaagagcccaagctaatacagtcacctctctgtccttatcttgcttgtctgcttagcattcaatgcctgttttttgaaggactattgtctttgggtttatgtgataccacatcctcctggttttctttccatctctctggttgcttcttttcagtgtcctttgctatctcttccagctttactgatcctctaaatgctagagtccctcctgaccaggactaaatccttttgtctcttttaagtcattcttagtggtcaaaaaggtatgcacttaggtgctagggtaccttggttcaattcccagccttgccacttcctagctgtgacctcggagaggtcacttaacaattccttgcccatttcttttattattattattattttaaaaaaacctatttcgtagggctgctaagagaataaagagggttaatcatacctaaagtattttgggcagagctggttcattatatgcattcaatgcatgttatttttcttacaattgttagtaatcatcaattcccatggccttaaatgttacatatatgctggtgacccttaaatatgtattttcagccccaaacacccctcttagctctataaaattatgtatccaaccactagaatttatcaaactttagaagactaaattcaaattttgattactaattcttaacaccccccaatctcactcaacaatttccccccagttttctgcatcttagtaaatggtaagaatacctgcctagttgtttaagtcagaaaacttggaatcatctatattgttgctctttccctcctagccacattcaacctatttgtcaaattctgtcatttttatttataaaatatagattaaatactttcacttctttgtatctcaacaattaaaatttctaatccaatgtaccatcataacttggctagtttactgcaatatcttctttacccattctttatttttcctccatgaccaaatccattatttgccaaatagagttttgttttacaaacataaatttgtgtcattctcctacttaatcctttaatgattttgccctgtgcaatgagtcaaatccagtctgcaagactctgcttgacttgctgtatgtctacctggctggtctcatcttatatcaccttctccctcaatcatggtgatttggtcacatcaacctccatcagtttcttaaatccaataaaccctttcctgccttagggcttttgcgcttgctgtgtcttcaaccaggaataactttttccttgcttctttcattactggttttctcctgaggtctgccattaaaaaaccctcaacttcagaaaggcctgctacatcactcagatttctccagagaagagagatgattggatctatgtctatctatcatctatccatctgtggatttattttaaagaattggctaatgtgattatggggaatggcaagtccaaaatctgtagggcaggtgagcaggctggaaactcaggcaggatttcaacattatagtcaaggcagaatttctgcttctctgggaaacctcagtttttgctcttaaggccttcaactgattgagtgagccccactcacattatcaagggtaatctgatctacttaaagtcaactgattatagatgttaatcacatctacaaaatatcttcacagtaaaatatagattagtatttgaccaaacaactgggcaccctagtatagcttagttgacatataaaacttatcatcatactttccttaggtctcctgcatccacaggagtctctttcatagagttctctctttttttttttccattggatgtaccataatttacccttaagtaattctttgcttacttattaatttccccttcctccaccacactctaatgtctatcaggtgagaacgattcttttttgcatcaatatatatccaatactagcaaagtccttgggatatattaagcattcagtaagtagttggtgctcgatgcttaatatgtgtttgtgaaaacaattaacaaccacagggaacttgagatgaaaagttttgacccaatcttctaaaatttttatgggagttagaatatcagatgttaagcataatttactaaaatgtgaatagacaagaaaataactgattatttctcattttcttttgacacattctcctcccttgtattttcctgaaattaaattagtcaacacagatttaagaggacttagagtctcacacactcagcccaaatatagcattgaaaagacttccaaagctttggcaacatattttattttaataaagattcaaatgcctgcaggatcactggaataattgccagttacacttctattaatgaacacatttaaatggggattgtgaaaagcagaaaatgatctgattttatggagtacgtttactgccagcaatgtacagtgatgaatggtgccctagaatttaattttagttttagccacaaaacagccaaaattgcacagcagcctctttaacgaatatgtactgaacttgaaaaattatttattgagttctcagtgatatatatatatataaattatttattgagttgtcagtgctatatatatatatatatatatatatttttttttccttggagatggagtctcgctctgtcacccaggctggagtacagcagtgcaatcttgctcactgcaacctctgcctcccaggttcaagcaattctcatgcctcagcctcccgagtagctgggactacaggcatacatcactatgcccagcaaatttttttttttttgtatttttagtagagatggggttttgccatggtggccaggttggtcttgaacatgtgacctcaggtgatccacccatctcagcttctcaaagtgctggtaatacaggcatgagacaccacgcccggcctcagtgatatatttttgtgaaccaattagttacttcaaaaaataaagaagagtaatgctgttaaagttgatccacatagcagtcttattaccacccttgcatgggctctgtgctgtgaagactaggttctatgtgcaacaagttctattaacaagcctctttggatgaagctgcttttgaacttgatatgcattcagttctgatgtacagtgctaaaggaagtagaaaatctcaaagggttcataagacagagtcttagtactatttctaaatgctggttcttcaagtggtatttgagtttgaagtacatcagttcacactgctcccagactaaaacaaaaaaatgtcttagaaggattagctgaatctaaggaaactttttaggaatattaaccagaaaaattcaggagaagcaagttttgttgactttatcagaatgctgtttgttcccctaaatccaacttctccttttgcatttatatactgatatttagccagaaactacatttcccatcttcccctgtagctagatgatccctgtgactaagtttgagcccttaatgtgaataaaagtgatgtagagactcttcatgttatctttaaatccagactcacttgcccctggactatgactacctcactttccctcaggatctgaacatgacactgacccagtttataggatatagatggtagcaagggatagcaggacaatgtgttggaaggaacctgggtcgctgaatgacatcctgctagagcagagctgccacatcagcctggaccaaaccaactatgacttgaaagaaaatgggagctttcttataggattgttgcagatgaatcaatacagaaaatcttgaagtctttagaaagacttgtaatgaatttttatattatttagaggttacttttacataagttgtttttaaaaactacctacattttaatgttatgtctttaagacatcaaaaattatgctatctcttttgatttttgcaaaatcccagtgagggaatcattatgagaaagattatgttagcttctggaggaactcaagggacagaataaaagtaaccacaataaaggcactattttcagatttgtcctctgacaactctttgtagggctaagaacaaatctgtgttttctaactttttttagggaggtgactctcaaatctgtatgtgtgaatatatgtataatattaccattgcgataaaacttataaagtgatgtctaacaagtaagtcattagacatccagtgcttagcatgtacccaaattcaactatattccaatttgaataaagcatatatacatctatagagatatagatctatagatatagatatacatagttttcaaaaagcaaatatctacctatagacatctatctctatatatctatacacatagatataagaatatattagattcccctattttagattattcttcaaaaagcaagtagatatctatattgtataccatgtatatatctatattatatatatatatatagataggttatttttcaaaagcaaatttatatatatatatgtacataatgtgaatcaaagtttgagagggggaaaaagaaactttaagaaagaacttctagattatacaacacaattcagagtactggcatgataataatggtgctaatagtgataatgataatagcaataacaataatagcagctacattttgagtgttgtcatgagacagggtctgtgctttttgctttacattcattgtctttgcaaagcatctatgagatgttattcttcaattttgcaggtgacatatgaaacccagggagtatcttgcccaagggtaaccagaaccagaatctaattacattataaattttacctcaacatatatccatttttgcacagaaaagagttagcataacaggtgtgagatcactgtccttagaaaggcctgcttgcaaggctagccacttggatgttgggaaagtgtctaccattctttgaagcaaatggctcactgtgcttaaactgtgcaaacaatatggtttatgttgaacatctgctttgcttcttggagtctggaatttgggtacatactaagtactgaacgtctaatggcttccttgctagacaacattttataaatgctatcacaatgactcattgctgggagaattaagcacttcctgtgagacttcactcagaaagaactcttggaagcttgcctcaggtttcctccaaacattaccccatgtgccttttccctttgcagattttgctttgcattcttttgttgtaataaatcataaatgtgtgattgtatattgggtcttgtacatcccctagcaaatcttcaaaactagagacagtcttgggaacccctaacatatctatcttccatgtcattctctcatttggagaaaataaaattttattttctacctgagtacataggaagacgtatttctcagcctctcttgaaatcaagttggaccatatgactgagctctgatgggtggaatgtctgttagtccaaaataggcccatcaaatgccccacaccatccttctgctctcaactgaggaccagatgcagatgacccagtggaggaagctggcaccataggcaatagtggaaccacgagatggaaggagtgtcctcaataaatgagttgaacagaagtcccatcctgtccccaacggagtcacataggattaggaaatgaaagagaaacaaacatttttttgtcttaaaccactgagttactggagctgtgtgttacagcattgatccttctctgtctaatacatatggtgacgtgctggataccaacacccccatctccttccgctcaactttgaaatatgttgcaagagtgaaagggatttttaagccatagagatcccattactcatttgatagaataatatttgatgggcaaacacaggacacgaataatctaccagatggcgactcttgcaagggaatcaaaggaagttcttcattaccatttgagattgctcttaacatttttgagtagtacttgataaaacaaatagaaggtgttaaactactgggtgtagttcttttactaaaggagccatgctctttcactccccctattattagattatttttcaaaaaagcaaattaacagcacttcaattttactcagtagatgtggaaagaactaaaaagaagaaagtgagagaagataaaaattttattgggctggcctccaatctttttgtttggggtcattcatttgttcacatatatttattgattacctgtcatatactagacacagcctgaagggctgagaattttgtagtaaagaaggtgcagcacctgctgtcaggaagcttaaagaataggggaggagtccacaagcaaagaggaaacccaaaataagcactatgatgggagcacatagcagagtctccaaacctactttaggagatatcagagaaagcttttccacagacaagtctttcaaccccaaaactctcaagatagctgtgagtcctcctcagtttccctccccttttaatccaaaacatcacgacgtccactcagctcaacctccaccacatatccaagcccatcatttctctccttctctacttgctactaccctggtctatgccacatctcctttccgtcttaatctcttggaccagatttctagagggtccccaattttactctgatgtcttacactccattttgcttagagtagccctccagggccatcttaaaaaaaaaaaatcaatgctttgtttgtatctgaacttttaaaaactggtagttccccactatccttagaataaaatacaaatgacgttccaggttccagccactcttgctcactcttgcctcatgattttgggttgttctttatgcctagaaagtccttttttctaccttcccatggccgtgcccttcttgacattgcagatacaatgcaatgccacttccctttctctagccgccccatcgaaagaagctccctgctctagttctttgtaacaaatgtcatcctccttctactgccactagatattttcttatttaactatgtgtttgctttttgcccctcttttcactatcttcccccaatggaatacaaactctaaagaaaaattacctgtctttttttgtcagtgtatcctaaataccttttacagtgatgagcctgaactcagcactcagagaataagccatgaaaaaatatattgaaaggaagtctaagtatggatgtggagaaggtgtagctgttgtcctgatgaagaagggaattgtgggaagcagcatttctcgcaggagaaaaagtccaggtcaaggcccttcagaggggtgcacttcagctgcaggcagttccttctggctggagcagagtaaatagggatgagtgaggggtgagacgcgaaaagtcagcagaagatggttggtcaaggcctggctgatcgtgaactagttgggtcactgcagtatagacagcatctaacccaatatctgacttatagtagatgttcaagaaatatttgttggatgagcatgtaaggcaattgagtctctcttctaatggcaaaaaaaaaaaaaaaaaaaaaaaaaaaaagccagcaattggttttaagtaggaactgactggtttctatttgttctttagaaagaccttttcagctgcacagtggagaatggttcagaggaagacaggactgtaggcaaggagtctgggtcattgcagacatgcagatgagaggtgacagtgacagcagcgtgtgagaggcagggcagtggagagggaaaggcagaggcagatttgagagatacaaagactggagaattggctgagcttggagattaattagaaacaagaggttctgagggaagagcccagaaagacaactggatttacattttttttttttttttgagacacgatcttactgtcacccaggctggagtgcagaggcacaatcttggctcactgcaacctccacctcccaggctcaagggattcttgtgcctcagcctcccaagtagctgggatttcaggtggacaccaccatgcctggctaatttttgtatttttagtagatatggggtttcgccatgttggccaagctggtcttgaactccaggcctaaagtgatccagccgcctaggcttcccaaagtgctaggatttcaggaatgagccaccatgcccagcctggatttctaagtgactgcataaatgaaggtaacatttttgtcaaaataatctctccacacagatgtatgcacataaaatatacctatgagaataaaggagaaaactaacagtagttacctctagcaaggtgggatgagaagtttcctgtacctaggacacttcgatatttcaatttctaaacctctgtatgatttcaaatgtttagcatgacattttatgagtttaaaatttgaaagaaggccgggcatagtggctcatgcttgtaatcccagcactttgggaggtggaggcaggcggatcacctgaggtcaggatttctagaccagcctggccaacatggtgaaaccccgtctctaccaaaagtagaaaaattagctgggtgtggtagtgcacgcctgtaatcccagctactcaggaggctgaggcagaagagtcccttgaacccaggaggtggagttttcagtgagtggagatcgcgccactgcattccagcctgggtgacagagcgagactccgtctcaagaaaacaaaacaaaacaaaacaaaaaattgaaagaaacaaataaatcaagaagcatctaaatgccacagaatatattagattgatgcaaaagtaattgtgatttttgccattgaaagtaatggcataaaaacacaatttcgttcacaccaacataatgcataacataaactaatgcttaacatatttcaagatgacattactgagtcattatgaatttttaattacattatgaagtttagttacttttgtacatagaagaataaggaaagaactgaagggctctgatatcttttgacagcactcttaaagatattaagtaaaacatttctcatttattttcttatctacatggatattaatatcctaaatttttaaaggatagtttcatgtccagagaatctaagccattgttcaagctcagaaatggcagcggtaaggtttgaaccctggacagcgcttgcactatgtcagtctatggaagtcaaaagggaggtcgtgttaactgcataggcttataggcaatcttcccttcagaaagcccttctggttggaaatctgacagacagttctgctagggcaaaggaaatagcattttaactctgttcttaccttaattctaaagtacatgaataacactttgctcttaaggaaggccttttatctgagtctttcaaacactgaacaaaaccaattattacccaccctccttcatggttcaaagagaagattttaatccctaatttgctgacagagagacagaagccggcaggaatgaagtgatttactgagggtaacacagtctatgaaagcgttcaagaataaccctgagggcttgtgacaaaagagcaattgccttatgcaattagcagtgaattcctctgtcctaatcactgcatcttactgtttcccatgcaaagtttaagggaactaaacttctcctctttcctttcccaccataaatcggacgtagtgctttttatgtaaatgtactttgcaaaaatgtagatccctataattttaccttccatctgtttcatctgtttttaaagatcttactgcagaatttcccaaacactttgaatggggtggaaaagccccatacaagaactcagatgtcctgctggttcctttggctacaacatcaaaactcttgcagaaatgaaacaaaaaaaaagtatgcttctgttcttcatgaaattgcccaaggagggtgtctggataataagccaaacatggagggtggggattaactgcatttgagatgtgactgcagagcacattaagctgctttgctctacaggtgttgctgcttcctcacaagctccactgtgatggatacaacctatgtgacccccagtgagtcacacctttttaaatctcctcatcttgagtgctgagatgtgcagtgtaaggtcccctgagcaggctgcaccatggtcaagccatcatgacccctgtgacccacatgtacacatccagaagtctcaaattctgggagccagaaagtctgggacaacaggaaaaccactaaagaagaaaaatggctagtacctgtcttagctgattaggtaaccctgcgacattctaccattctagcatgctctaccctaactgatcaatcaacctagtgacactgtgctctatgacccctcccaccttgtgataatgcaccttgcaaccttcttcccctgcccacaataaatggcccctaactgtaactttccactgcttaccctaatctatgaaattagctccaatcccaccaccctctgctgactccctttttggactcagcccgctcacatccaggtgaatagacagtcttgttgctcacacttagcctgttcaggttgtctcttcaattagatgcgcacataacacagaggtgatgggatgagatgccacacccatgactgtactacccattagaggactagagagaccctccgttgttggctttgaagaatccagctgccatattacaagggagcttgcaagaggaccaggtggaaacggactgcaagtagcctctaggggctgcgtggccctacattgacagccagcaagaggggaatttcatatgtgcaaccacaaagaattgaattctgccaacaaccacaggagcttagaaaaggatccacgatccagaaagaaatgcagcccaatcatgattctaactgtggcctcatgaaactccaaccagagcacttagctatgtcatttctgaactcctgatccttgggacagtatattatgaatgaatgttttctaaatccatttagtatttggcaaattgttacacggcaacagaaaatgaatgtaaacatctttctattttagataaaaaaagatagtaacataacatttaatgtcaaaaggacattagcaggtattaaagtgatgccttaatgatatatttgattttaatggataattttacctattataatccagagcaaagaaagaaaaggaagcaggggaagattccatagaagaaggaaccagctgtctgaagcatagaggtctaactatttgcaactcatcctgtgccttaaaaatgggaagactaggttatatattattaattaatgacagaaaaagccaaagcagcattggcatcactatattaaaacttagtgccccactatatcatttacaaccacctaaaattgaactgaagctataactggtttcgaaagagtgcagcaaagcaagattatgaaacatatatattgatatttgtgtgaccttttgaccattggttctcaaatgaggctttctgttcactgtctgttataatgtaaaatatttttaatagattaaggacttcagattaaaaaaaagaagaattcctaaacatcatcccagttaactgaataaaaatcctcaaaaataagacctcttacctctctccaacccctacacacacatacgcgcacacacaacacacacacaccaaagacttcatgcgattccaatgtagctagcctagtcattggtatttgtcatgatagagctcatcactaataggtcatttctttttgtgctagaagcaccttgtatatgttatatatctagttcaatggttctcaatcttgcctacacaatataattacttgaagagctttataaatcctaatgctgaagctttttcccagagcaattacatcagaatcaccaagcatagtagccactatttttaatttgtaaagctccccagatggttgcaacgtgcatttaattttgagactgctgatctgtagataatagtttgcattttctgcatccttcctaatatataattatgtagtccaaaacccaaacactgcctgggaagtatgtaggccaaccacgactgtcccactttgatggaacatacaactgaggttgaccatttggggccatactataataactcctttttattgaacttcatgtttattatatttatttctttaaaaaagtgcaatctagttatcattatcccagtttatagacaaagacacatcgtctcctgagtcagagggaactgcccaaatgagtaacatgacctgaggctgagtgacaccgaagcttatgataactgcacaaaaccagtgattctcaaagtgtgggctccagaccagcagcatcagcatcaccttggaacttgtaaaaaagaaaatgcaaattctatgacccaatcccacctctactaagtcataatctttcaagatggggcccaggaatctgtgtcttgacaagcccttcaggtgattctgaggctccttataggtggacagtgtactgtattctgtctctatcagctgctcacttttgagactcagaatctggcaagagacctaaaaatgtgtgggagcctcagtgagtaagcctgtgtgagggaggagatatttctctcactatcttcccttcctctcatttccaatctatattaacaatctatgttgaaaatgctaggggatgtatcagagataccatatgggaaaaaattggtggagttatgctggtcatatttacttgcaggggtgcctggctatgttgagctactttcacacaagtgtgaccattttaatatgttgacgaatggtttatcctttgaatcacagtatggagagttttaatagtttcattaaaaatgaatatcccaactgtttccagggaaatgagtttgtgatcttaagggctttgaggtaattggtgtttagggaaccaaggcagttggtttgctttcttggatggaagctgcttcagcttactaccatgctgtaaaacccaagtgctgctgacctgcttagtgtatttcggctatgcttagggttcatttattagaattgtacatttgactagggggaaataaaaattaaaaggccacttgtgtttgatttatgagagatgtcgattaatattttctgagcaaactgtgaagtcctttcttttaaagaagtatataaaataggcctttggcatattcaggtctgatggaaatttgtctcatggggcagggtgagatgggagaaagagaaatcaataaagatagagaagagaaaaaaatagaggaagaggaggatggggaagagctgaaaggagacaataattcacaaggggaagagacagaagaggtgaaaaaaaggaaagcaaggaggagtgaagaaataagaggtggggtcagaaggattaaaaaaggggaaagaaaagagtttgggaaaatgggggaaggagagaaaaggaagaagagaaggacatatgggcaacaaaaaaaaacataaaataaaaaaaaataaagcaatgaatgcagactttggagcctagcaatttattgtgaagtgccacttgtattagacatgctgcagagatgctggctccaaagattaatgatggcagtaatcatgattccaatttatagcaaatgcaatgaaaggcagccagaccccaaacagagaaaccctacggggatggcattggaataataacatagcagcagtcgaggaatacagggatgctgagagattggattcagttctcctgtgttcaacaaacattctgtatctgatgtacaatccaatgttaaaaagaaaaaaaaagtctgcttattactagatctctgaattatagcaaagaagtttaggtgttcacatgaacacatttgaagttttattctgtgattcacctcctctgagcactgacttttggcccagattggtcttttacacctcctttcctttctgtccttgctgctcagtgtttttctgctgccagtggtcaataccactgtttcattgcaaatacctgctgtctctgaagcctggaaccactgcagaataggcataactactcatcctctttcctggttgtcaaaacccttttccctttatgcatgtttatttgtatgtattgtcttgatatattacctatcagattcctttaatcagtggtctgtgtgtgtggtgagcactcatctccattataatctcctctgcccccacctattgccacgaagtcctaggtctttgcagatgatcaaattttggagaagaaacaaatttactctgcataatagagggagaaaaacttagaaagcccagggcaaggagaaggggctgaggagcagaaatgggagaaagacagactccattcattcagacagatggtggaaacttgtgtgcaatgcgcatgcagaaaccctataaaaatattctgcagtgtcaactaccggtatgaattctctgagtaaattgctgttgtggattccaaagaagaggtagagattcatatctagtctgcataaggttggacaaaggcagcagttgtggtggtcagatgtgaagaggatggcattagaagaaatccttggacatcacagacttctacacgcactggaactggggttcttaggggctgggtttcaaaaggatcaaagcaatttaatttggatctccaggggtgcctgtagctactttggtttccatatgtataagaacaaactatatgttgggatgtgtatgctatttgatacataaacatttgatgcctttaaggatgaactgttttcagatagattcatgacagcaagttttctctccctattcagaccataagctccttaaggatagaagtgtatcttctctggcttttgaataacctgcagcatctagtttaacccttagcacatacaaagtatttggtaagagactgtgtctcatagtcagcctggatccactcactttctctcaccccaccctctggggttttctgggctctcattcccttttgaagatggttcacccaggagggagggtcatctgcacacctggattgcagagaaccaggtacagtgatgacctacagacacctgtggtttacagacattggcagcatggttttttaaactataaaagttacagtaattatcctccaattccaggaatggaatcccttgataggcctcaatctacattcaagattcaagtcaagcaccagcctgtatttaaaaactaaggaaacaatggaagtttaatgaaattatgtcattatagttgatgaagagaaaatatttcaaccaagaactgaattgaataaaactttctcagaaactctttgtttaatgggcaatcacagtatgccagcatgggtgtgccacagagaatcaaagtccacagatactgattatattcctatctgggaaggatcagtatgaaatatacatatgatggggctctcatagaatgggatattttcccccttttcctctcatttctcaatgctcctctgggaattgtgtgaaggtaaagtcaaaaagaaagttcttacattcttaaatcctctgtaaaggatctgaagctctttcttggtaaatttgctctgggcttccagaagctcaagggcttcaggccgatgcctgacggtggccatctccagttcatcttccacgctgtctgtggaggaaaacaagaaagagtcttaggaccagccactgctcaccgatgcttacacagagcaacaaaggaaaacggaagaacatgtctgctaatgtctgtgactgtccacagaggaaggaccctcacaatgcctataaggcctttacatttcccagtttaagcgtattaagctaaaacacttgtatatgatttttttgcatattcttgtcattaatgtagatattacaaccctagcattgttttaagacaacaaaaaagagcacaggaatttatttcagataatcagtggattatatgattacgtcaaacaaaaagtttaagtagcaatatatattactctataaatctaacagtaacatatatttcttttttccccaacgtttaagttcagaggtacatgtgcaggatgtgcaggtttgttacatgggtaaacatgtgccatggtggtttgctgcacagatcatcccatcgcccaggtatgaagcccagcatccattagctgttcttcctgatcctctccctcccccaacaggtgcccagcatgtgttgttccctggcagtgtccatgtgttctcatcaatcagctcccacttacaagtgagaacatgcagtgtttggttttctgttcctgcattagtttgctgtagagaatggcttccaactccatctatgtgcctgcaaataaaatgatctctgtcctttttatggctgcatagtattccatggtgtatatgtaccacattttctttatccagtctatcattggtgggcggttaggttgattctgtgactttcctattgtgaatagtgctgcaatgaacatatgcaggcatgtatctttataatagaatgaattatattcctttgggtatatacccggtaatgagattgctgggtcaaatggtatttctgcctctaggtctttgaggaatcaccacactaccttccacaatggttgaactaattcacactcccaccaacagtgtaaaagtttccctttttctctacaacctcaccagcatctctagcatttttaaggtatagttagaaaaacatagaagatcacaaatagtccaacctggaatttgtttctatataacaaccactagttataaacaatggaattgtcatttaataataatcagttttgtgccctatgtaaaatgcaactacaagatagcctctgataatgttcactaaggattccaatgaaatcagatattttgcacagctacttgggaggcggaggtgggaggactgcttgagcccaggaggctgaggctgcagtgagcagtgatggcaccactgcagtccagtttgggtgacagcatgagaccctgtctcaaacaaacaatcaaacaaacaaaaaaaatagaaccttagactctcagaatggaaggacatctgaagaaagatataaggagatagagaaagaaggaaacctccctaattcattctatgaagcatcaccctaataacaaaaccagcaaatgacataaccaaaagagaacactacagactgatatccttgatgaacatagatgttaaaatccttaacaaaatactcactagctgaatccaacaacatatcaaaaagataatccaccatgatcaagtgggtttcaaaccaggaatgcagggatggtttaacatacgcaagtcaataaatgtgatataccacataaacagaattaaaaacaaaaatcacacgatcatctcagtagatgctgaaaaccattcaacaaaatccaacattcctttatgattaaaactctcagcaaaattggcatacaaggcacataccttaatgtaataaaagccatctatgacacacccacagccaacataatattgagtggggaaaagttgaaagcattccctctgagaatggaaacaagataaggatgcccactctcaccactcctcttcaacatagtattagaaatcctagccagagcaatcagacaagagaaagaaaacaagggcatccaaattggtaaagaggaagtcaaactgtcattgtttgttgatgacatgattgtttaccttgaaaaccctaaggacttctccagaaagctcctagaactgataaaagaattcagtgaagtttctggacagaaaattaatgtacaaaaatcagtagctcttctatacactaacagtgaccaaacagagaatcaaatcaagaactcaacccctttacaatagctgcaaaaatataaaatacttaggaatatacctaacaaaggagtcaaaagacctctacaaggaaaactacaaaacactgttgaaagaaaccataagtgacacaaacaaatggaaacacatcccatgctgggtagaatcatggatgggtagaatcaatattgtgaaaatgaccatactgccaaaagcaatctacaaattcaacataatccccacagaataccatgattattcttcacagaattagagaaaacaattctaaaattcatgtggaaccaaaaaagagcccgcatggcctcatagaaaaagcaagactaagcaaaaagaacaaatctggaggcatcatactacctgatttcaaattatactataaagccatagtcaccaaaacagcgtggtactggtatgaaaattggcacatagaccagtggaacagaatagataatttggaaataaacccaaatacttacagccaactgatctttgacaaagcaaacaaaaacacagagtgggggaaaggacacccttttcaacaaatggtgctgggataattggctagcctcatgtaggagaatgaaactgggtcctcttctctcaccttatacaaaaatcaactcaagatggattaaggacttaaatctaagaccagatactgtaaaaattctagaagataacattggaaaaacccttttagacactggcttaggcaaggatctcatgaccaagaacccaaaagcaaaagcaaaagcaataaaaacaaagataaatagctgggacctcattaaactaaagagcttttgcatggcaaaaggaacagtcagcagagtaaacagacaacccacagagtgggagaaaatcttcataatctatacatctgacaaaggattaatatccagaaagtacaacgaactcaaatgagtaagaaaaaaaccaacaatcccatcaaaaagtaagctaaagacatgaatggacaattctcaaaagaagatatacaaatggctaacacacatgaaaaaatgctcaacatcactaatgatcagggaaatgcaaatcaaaaccacaatgcaatactgccttactcctccaacaatggccataatcaaaaaatcaaaaaacagatgttggtgtggatgcggtgaacagggaacacttctacattccttgtgggaatgtcaactagtacagccattatggaaaacaatgtggagattccttaaagaactaaaagtagaactaccatttgatctagcaatcctgctactgagcatccgcccaaaggaaaagaagtcattattcaaaaaagatacttgcacatgcacgtttacagcggcacaattcacaattgcaaaatcgtggaaccaacccaaatgcccatcaatcaatgagtggataaagagactgtgatatatttatataatggaatactactcagccacaaaaaggaaagaattaatggcatttggagtgacctgaatgagattggagactattattctaagtgatgtaactcaagaatggaaaaccaaacctcgtgtgttctcactgatttgtgtgagctaagctatgagaacgcaaaggcataagaatgatacaatggactctggggacttgcggggaagagtgggagacaggagagggataaaagactacaaatattgtgcagtgtatacgtgggtgatgggtacatcaaaatctcacaaatcaccactgaagaacttactcatgtaaccaaataccacctgtaccccaataatttatgaggaaaaaaagaattgaaggacatctgttcattttacaagtaaagtgaaaaaagaaatcagatattttgccttgggctacaaaataaaatgttcatattaggtgctgacaagggtaaagtaaccagcagccagttggtttcatgggtacatactggatggttgggggcctagaggatattctatttaggtccattttgtagtcaatagagtcaataggtatagagaagctttaaaatattgtactttgctttgtgaattatgtttacgctataatttctcaaagatgttttatgcaaaaaggaattttgtgcccatagatgtttggaaaatgctgtgaactttaatgtagttttgtcacaaaatattaaattatataggtttgcgaagacctgtaacaaggagtcttgtttaactttgcgtaacccaactgaccccaaaggtatttgtccatagaacctttcctggcccaagtaacatctggtaatatctgcacatttgccctagggtcatgtaagcacaagtctggaggatttggaaatatattagggttcaggtgcttgtgtctcaaatatcatccttcagtccagctcctttgaagtggggtcagatagtggcctataggaattctctctgttgtgtaaaccaatccacacctcagatgaggaacttagcaggaataaaaacatccaggctcagtatgaagccttggcttcccctttctatcctttcttcttgactacagattggagactcagagagaagggtctaaggataacagtcagctcctctcatcccagagccactaggaccccaatcccttgtcccatgggtcagttggaaatgtagtcctttttgccaaagtcgagccatttttgacactaatattgctgcctcttgctaacatctgttcctccttactactctgcctcactgagagcattgaggggccaaagctctcacttggcaaggaagagaaggtgagtggcaccctaatcttagcatatcttaattattgccctcaaggagtttacaaaaaaaaaattggtgatgaaacaaacacttggagtggctatatttgtgaaaatgagtaataggagatgaaaacaaacatttgctttgtactttttatattataataacttatctggaaagaatgaaatggaaaagcttcagaatagtgacggatgaataaaaataatagaaaaggacatggaaagatgagaaggctgacaaggataaaattgatgggataaaattgagctgacaaggataaaattgatgggaaagtaagtagttgtgctcctaaagtatgtgggaagagctcaaagtagctggaaaaaggcacctaggcattaacaaattgatctgggctttatggggaaaatcaaaaaagccaaaatccttcaattttctccttcattcatttgaacaaatgggttgattctattcaatgggtcctgagatagaaaagatgatggaaaatgttgcttttagactgctgttgatccaatgacttcaactatgttgtattattgtatttgccaatgcaggagtaaatagcatgcaatagacctcatgtaaatagataatatcgaatagaaagcctgtgctttcttgaacaatgtctgatgtaatcttcttttgaatcatttatagtgcaagttcttcaacctaaaatgttccactttccttttccacctgttaaaatgtatatatctttcatgatccaatttaaatataagtgtctcatttctgaagcctctctggattcccatactatgcaaaattggtgaccccctggtcatcgttcccacactctggttcttgtatagcatgtaaaacataacatcatgatctgctcatgtttgttttctccattgtgagttttttttgcagacaagatcaatatcttacatgtcttgtttatcctctgaacctaacaggaagtctgatactcctttgtcacttaagaataatctggtaaacaaaggatattcctgctcaactttctgatcctctccaatcccttgaatatttgctgccctatagggaaatatttttcagactgaaatttgtgggctgttggtggacctcaaatgtcttcttcagaatcactatgttctctatttattgtactgggaaatacagcaaaagtagaggggattttaattaaattttctgagcagtctttcagtcataacataaccttgtctagacctagtgaccctcacatgggacagaaccaaaacagcggattaaattctgggcctttgtatcgggcagcaatctgagctgtgctacaaatggagtttctttctctgcagatgcaaagtctgagacaaaagacacagggctggaggatcagtataattaagtgtgcgtgataggatgatcatcacatgcagtattaaaaaaaaaaaaaaaacgcccttgaagtgtctgcctgtgggctctcttgcttttccagctgtctggtaccttacttcttaatgactcctacctgccaaagggctgtttctatttctaggcgggtgacaggctctaaaaacataactgaaatcatcagcaatcaccagcatatgataagttaaaaaagcaacaccaccgaacccaatcaactctgattcttggaggcaaactatggggagcacggcatgatcccacgtaggactgcgaattctcattgtgactcagccaccttgtaagagcctgtattttgggtggttttaacccagtgcctaacatttattgagcccttgttgtatgccaggagatgggcaaggtgcttgattggcataatcctaatcctcacaataaccccagagtgaggtttaattgtttatttttcacatacatggagactgagtctcatggatgtgaagaaattcacaaccagaagtcaaatatgtgtttatatatacataaaaacataacatatatatctcctatgcatatatatgggtttccatatatatgcatagggacaagatttacacccaggtctttgatgccacagcttatgttcttcccacttcccactttgccacagtctcttttaataccagcagaaataatgatacaaataatgataacctctcctctcttattttgtcaaactcctcagaaaagttaactgtattcattagatccattttcttgctctctccttaatctactgcagtctgacttctggtcctatggtggactgaattgtgtccctcctcaaattcatatgttgaaggtctaaccctgtatttggaggtagggcctttaagaagatagttaagcataggccgggcgtggtggctcacacctgtaatcccagcactttgagaggccgacgtgggtggatcacctgaggtcagaattcgagaccagcctggccaacatggcaaaaccccccatctctactaaaaatacaaaaaattaggcgggtgttgtggtgggtgcctgtaatcccagctactcgggaggctgaggcagaagaattgcttgaacccaggaggcagaggttgcagtgagccgagatctcgctactgcactccagcttgggcaatgagagtgaaactccatctcaaaaaaaaaaaaaaaaaaaaaaaaaaaaaaagaggaagacacgaggaatgtgggcttacagaagaaaggccatgtgaagatggagtgggaagatggctcacagctggtaccttgaccttgaacttccagcctttagaattgtgagagaataaattcctgttgcttaagccacccagtctgtggcattgtgttatggcagccctagcaaactaatatatctacctatattcaaatgacacacaacactgataaaagcaggtcttgttatccacaaagtttgcacaatgagtgctgggcagtttgctagccaattatgtcatttaatcttcacaacatctttcaagagaaggattatcatccctattttataaatgagaaaattgaggcttggagagtctaagtaacttggccataacccaagcaactcttggccaaatggctacttagtaaacaagatgaagacaagtgtctccagcagcccaaagtccaggttactgagcactatgctgggaatgttaatagcaaccatcaccctatggagaacttttgctctaagcgtggttgtatattatcccattttaatacagacagaagttcagtgagatagctacattttacaagaagtcatgtagccctcattttacaaggagtaaattgggactcacatttcttaaataacttactcaaggtcatacagcttacaagtgacagggctgggatttaatccctggctttttaacaccaaagaccatgagcttagtcaatatgctactttaagagatggcaacaattaaattactttgttcaaaatcctaggggataaaagattttaaatcacaaactagctggctgctgagcctccaatgcctcaatttctttccagggaaaatatgccggggcaccttcaggagatcaccagaccagcagacaaagctgtgctgataagaaacacatggtagaataaggtacgaagtgatgggatctcagagctggaaggaacacaggaaactgtttgtttttctgcattttacccctgagaaatttagatttgggaaagatgaatgtttgtttgagacaaaaaccagaaccagatgggactctggcctctggagttatctccaggccatgcagacatatcatcactcaggtatcttgcagaagagccaattcaaatgcgcatttgcatcctgagataagcgaaatacaaatagtattttaattcatgtatcttctaacaaatttaattttaatcagacaacaaattcccaaacccagacaccattgagcttcctggctgtgtctttttgtcctttgttctttagatttcagtctctcagggctgagtttgtcctaagtctgactcaacagtcccctcaggccatgacacaattgggctagaaattggaattcaaatcatctaggaacaacagaatgcgttttaaaaatagtcatcgttctcctctttctcacaacttctcttaaaatacagtagaagcttggtacagctcaactcgtaattatgcaaatttgactctaagggcaaatcatgccatccagaacactactacggaacatcttgccttacgaacaaatatgagcgtgagtcctaccttttgacgacatgctttggaaacaagtcttctaatgcagaaaacaaataatattatgaagaataatgtcactttttgagaaagctgattcagaactcaggccatgtgtgcagagatgagtccttgcctataaagcatgaaacactgtgaggctgttgccttgttcttttatttaggtcctgccaaaatacgggaaggattatcttatttggcacactgaaggtgctccataagagaatgtgaaataaataactacttgaagcattccaagaatagtgagtgtatctacagcaggtcccatttcttttttttttcttctctttttttctttttttgagatggagtctcgctcttgttgcccaggttggagtgcagtggtgcaatcttgactcactgcaagctccgcctcccaggttaaagcgattctcctggctcagccttccaagtagctggaattacaggaacgccccaccacacctggctaatttttgtatttagtagagagggggtttcactgtgttgattaggctggtctcaaactcttaacctcaggtgatccatggacctcggcctcccgaagtgctgggattataagcgtgagtcaccgcacccagtcccatttctaaatacaacatgactcttctttaaaaataaatgtatccatttgtcattctaaaaagattataaatattgtaactttaaaattctatttgagctgaaattaatttgtctagacaaaaattcagcctgcttgacttatattgctttatctcattgataaaaataccctctgagccattactcctaatgtttacattttattaaattggccgaatagtgagttgatccatatggcaataacataatgaggatgatcactttctaatgatatcttatgtattattaaatatttagaagcttggtccagtggtggatattggaggaagatttccaatgctgaaagattcttgaccatagcattagatgctattcctgagaacttctaggataaggaggtgatgctattgtttgtttaatgttcaagtctgatacatcaggacaaagaaaaagctgcctggaggaagatttccaaagcgaattttcatggcactgatataatttatttccacccttcttttctactgcaaaaacttgtagagggatgacaacatactcaccattccattcctcggttccactgctcacaaagctcaaagagggtggcatgataatcagctgaggaaatagtttcttgggtggaggaatttgctgaagtctgcacagctgtgcagctgatgagtgtgggcacggggagccaggacctgccccaaacctgtctttccccttcctgttatatcatttgacctccctggatagagagtttaaactggggccaggccctgtaagcaactctttaaactttgacaattttaaatgctttattgcaagaatgcagaggtctgggaactcctttgacttttcctgtctttattactattcacccatccacctaccaagagttattttcaggtgcacatggagagtatagaagcaattaattccaagctgatcacacacaggctgcaagtagagagcagtcaatccatttgaaacactgtgggagtcctaggccttcccagaccaacccgagcaattggaatcctgatgttttagttagtttgacacgtatttctgcaaccctggccctgaatgtatgttagaaccaaaatacaaaaacaaacaccaaaaaatgaacaaaaccatttataattagtactttatcttacttaatatttgtatatcatattgaaaatgaacagttcttggaaaatggccatttagtttgaacatcttctgttacaggtacttgttggcaatgacattgcaatttccattctaggagaatgagaattgctttgcaatttcataattgaattcaatcacttatgaaatataacaacccagtggtgaacagctgaagctatttgccacagcacttatgaaatagattgtctctaccttatttacaaacataaataactcttcaacaagcttagattttaaaaaataatcacctaattggaatgcttattatcagcattaaccatattattactacagcatcatgaatggccccttatggtaggagttattattattattattattattattattattattattgagatggagtcttactctgtcacccaggctggagtgcaatagtgtggtctcagctcattgcaacctccacctcctgggttcaagcaattcttctgcctcagcctcccaagtagctgggactacaggcatgtgccaccacacctggctaatttttgtatgtttagtagagacggggtttcgctatgttggccaggctggtctcaaactcctgacctcatgatccacctgcctctgcctcccaaagtgctgggataacagacatcagccactgcacctggatgagttattattttttaggtggtagggtcttaattgatttttggtaaataagaaaaacaaaaattatactgccagtcattatgctcagacagaaaatctacaataggaatgctgagggggcagaggaaggaaacaagaaatttaattgaacttacacataaagacagaccaaaagagattgatatactagtcaggaaaggcaaaagctgagagggattatgagcaaagagaaaaattttaaaaagcaatggtatgtggagagagatgaagaaagcccagattagttcactaaattaaaaatgccctatcaaaggagtgcctcaaactttgatagattttctcttagttgtcctaaaaatcaataacaagacacacatatgtgtatgttcattacaacactattcacaatagcaaaggcatggaatcaacctaaatgcccatcagtggtagactggataaagaaaacatggtacatatacaccacggaatactatgcagccataaaaaagaacaagattatatcatttgcagaaacatggatggagctggaggccattatccttggcaaattaatccaggaacagacaaccaaataccgcacgttcttgcttataattgggagctaaaatataagaacacatggatacatagaagggaacaacagacactggggcctagtggaatgtggagggtgggaggaggaagaggattaggaaaaataactaatcagtactaggcttaatgtgactgtgcagtgggttcaccttacccactgcctagacagagccaatttatcaagacaggggaattgcaatggagaaaaaataattcatgcaaagccagctttgtgggagacccgagttttattgttactcaaatcagtctccctgagcatttagaggtaggagtttttaaggataatttggtgagtaggggctcaggaggtggggagtgctgattcgtcagtttggagatggaaccatagggggctcatagtgcggttttcttgttgtcttctgttcctgagtgggatctcagaaatggttgactcagattatcggtctaggtggtatcaactgattcatcaagtgcagggtctgcaaaatatctcaagccctgatcttaggtttacaatagtgatgtgatccccaggagcaatttggggaagttcagactcttgcagccagaggctgcctgacccctaaactataatttccaatcttgtggctaatttgttagtcctgtaaaggcagactggtccccaggcaagaagggagtcttttctagaaagggctattatcaatttgtttcagagtcaaaccatacactaaattctttcccaaggttagttcagcctacgcccaggaatgaacaaggacagcttaaaggctagaagcaagatggagatctctttcactgtcatgatttcctcagtgaaacttttgcaaaggaggtttcattaatacctgggtattttcgaccagacaaaataatctgtacaacaaacctctgtgacacgagtttacctaataacaaacctgcacatgcacccctgaacttagaagttaaaacgaaggaagaaaaagagcaaagaacaatcactaatatttatagcatttgttttgtgtaagctctctctttcatgagtgtatatgtatatatatacacacacacatacatatacatatatacatatgtataactagatatacgtacatgtaaatgtgtgtatgtatacatacatatgtatgtatacgcatgtatgtatacacatgtatgtatacgtatgtatgtatgtatatgcatgtatacgtatgtatgtatacatatccatgtatacacatgtatgtatacatatccatgtatgcatacacatgtatgtatacacatgtatgtatgcgtacatatgtatgtacacacatgcatgtatatatgcatatatatgtacacatatgtatgtatatatgcacacatatgtatgtacacatatgtatgcatatatgtacacatatgtatgcatatatacatacgtttatatgcatatgtatgtaaacatgtatgtataacatgtatatatgtatgttatacattttatatatacatgttatatatatataacatatatatacatacactcataaaatccccatcagcgtactataaatgctatattcttgttctgtagatgaagataccaacacagagagactaagtaacttgctcatggtcacaccataacagagtcagggaatggagtctgggaagtctggttccaggattcatgtaataactattcagctgttctgcctcccccagagcaggagagaggatgatgccccacttatctagaattcatgcacccaaataagaatcagaaaattagtagcaaaagggctctaagcagaaaatggaactctgtgagaattgaaaggggtattgagtccagccccttaactttgtaagttcatgtcacatacagagccttagctacagtggttgtaaatcaaaaaccattaggcatatcagtggcagaactgggcctaaatcttgatctttttcattcctactgcagcactttgtcagatgcctgcctcagtatcttttatggataagagtgtcttcatccttactgtacccacagttttagtaagcttccgattccacatcagaagcagatactgataatggagaaggagcatacactggaaggagtccatgagccacagttataatacctaattttcaccactggctcttcattatcatatctgagcaatgtgatattctgtgtataaatattgtcaccctgcttttatagataaagaaatcagggttggaagaaaggatgtaactgatgaaggacatagaaataggacgttatggagtcaggacttaaacccaagcttactgactctgaagactagaagtgactgcaggttgtctgagagtaatggagggaacataaagttgaaaaacatcataggcatattagagaaaagagtaatgacaaaagtcagtggctaacttattctttaagaataagttctaaccttattctttaagaaaatgttttattctgcttactttattttagaaggtaacagaaatgtgatacatttttaaatattattaattaaaattggcagcttattcatagtagccaaaatatggaaacaacttatgtccatcaataaacaaatggataaagaaactgatatatacaatggaatactattcaacattaaaaaagaagatcctactatttgtcacaacatgaatgaacctggaggaccttatgttaagtgaaataagcaaaacgcagagaaagaaaaatattgcatgatgtcatttacataaagaacctaaaaaaatgttgaatacacagagatagagaataaaacaatggttaaagtggggaggaactagggagatgtaggtcaaggtatagaaagtaacatataggatgaacaagtctagagatctaaattacaacatgaaaattatagttaatattgtatttgtgatctttgctaaaagaatagattttagatgctcttgctacatataaaaatgggtaactatctgagataatgaacatgttaatttgcttgactacagtaagtgtttcaccatctatatgtacatcaaaacgtcatgttgtacaccataaacatataaataacattttaaaacgtttatacaccttctgaaattgagtcagtaataaagaacctgccaactaaaaaaagctctggaccagatggactcatagctgaattctaccagacatactaagaagaactgataccattcctactaaaactattccaaaatatcaaggaggaggagcccctccctaactcattctatgaagccagcatcaccctgataccaaactctggcaaggactcaaccaaaaatgaaaatttcagacaaatatccctcatgaatacagacaaaaaaatcctcaagaaaagactagcatattgaatccagcagcacatcaaaaagttaatacgccacaattaagtaggcttcgttcctgggatgaaaggttggttcaacatatgcaaatcaataaatgtgattcactacgtaaacagaatcaaaagctggaacattatgatcatctctatagacacagaaaaagctttcagtaacaccctatatccttttatgataaaaacccttaccagactaggcatctaaataacatagctcaaaataataagagacatctatgacaaacccacagccaacatcatactaaatgggcaaaagctccaaccattcttcttgagaattggaacatgacaaagatgctcactctcaccactcctattcaacatggtattggaagtcctagccagaacattcaggtgagagaaagaaataaaaggcatttaaataggaaaggaagaagtcaaactatctctcttcactgatgatatgactctatacctagaaaatcctaaagatcctttcaaagggtgactagaattgataaacaactttagtaaagtttcaggatacaaaatcaatgcacaaaactcagtagcatttctacacaccaacaacgtccaggctgaaagtgaaatcgagaacacagtctcaattacaatattcacaaagaaaataaaatacttagggatatagctcacccaggaggtgaaagatctccacaaggagaacgacaaaatactgttgaaagaaatcaaagtgacacaaataaatggaaaagcatttcattcttgtagactgaaagaatcagtgttataaaaatggccatactgcccaatgcaatttatagattaaatactattctagtcaaactactaagaacattcttcacagaattagaaaaaaagtattctaaaattcatatggaaccaaataagagccagaatagccaaagcaatcctataagcaaaagaaaaaataaaacagaaactaagcccaagacatcacactacctgattttaaactctactataaagccacagtaactaaaagagcttggtactgctatacacacagacacctagaccaatgaaacagaatagaaaacccagaaataaagtcacacgcctaccaccgtctgatctttgacaaggctgacaaaaacaagcaatgaggaaaggactccctattcaataaatggagctgggataactggctaactatacacagaagattgaagctggacccccacctttcaacatatactaaagttaactcgaaatggattaaagatttcaatgtaaatctcaaactataaaaatcctggaagacaacctagggtatacttttctcaacatcaactgtggcaaataatttttggctaagttcccaaaaacaattgtaacaaaacaaaaatagacaagtgggacctaattaaactcaagagctcctgcacagtaaaagaaattatcctacacttgatcttcgtggatgaagctggaggccatcattctcagcaaactatcgcaaggacaaaaaaccaaacactgcatgttctcactcataggtgggaattgaacaatgagaacacatggacataggaacaagaacatcacacactggggcctgttgtggggtggagggagtggggagggatagcattaggagatatacctaatgttaatgggtgcagcacaccaacatgacacatgtatacatatgtaacaaacctgcacattgtgcacatgtaccctaaaacttaaagtataataataataaaaaaaagaagctatcaacaaagccaacaggtaacctacagaatgggagaagatattcacaaatgatgtatccaacaaaggcctaataccaagaatctatacagtagggaacttaaatcaacaagctaaaaccaaataaccccctttaaaaacgggcaaaggacatgaatcaacatttctcaaaagaagacacagaggtggccaacaaacatgaaaaaacactcagtattagtaatcatcagagaaatgtaaatctaaattacaatgagataccatctcataccagtcagaatggctattattagaaagtccaaaaacagatgctggtgaggctgcagagtaaagggaattcttacacatggtgggaatgtaaattagtccagccactgtggaaagcagtctggagatttctcaaagaacttaaaacagggctaccatttgacccagcaatcacattactgggtacacacccaaaagaaaacaaataattctaccaaaaagacacatgcactcatatgttcatcactgtgctcttcacaatagcaaagaagtggaatcaacccaggtgcccatcagtggtagattggattaagaaaatgaggtacacagacaccatgaaatactatgcagccattaaaaaagaaggaaatcttgtcctttcagcaacatgaatagggctggaagccataatcccaagcaaattaacataggaatagaaaaacaaatactgcatgttcttacttgtgagagttaaacattgaacacgcatggaaataaatatgggaacagtagacactacagactactgggaaggcgggacattgaaaaactacctattgggtactatgctcactgccaaggtgacaggatcctaattccaaacctcagcataatgcaatactcccatgtaacaaatctgaacatgtacctactgtatctaacatagaatttgaaaaagaagaacattactgtaaagagatagacatacaggtaatgtatttatgcaaaatatcatgcctaattcataagatgttactgtgttgccttagaaagtaggcagtacacagatggaattgattacctagtgagttaagcagagtttggataagcatagttataataaatttttgctggtatattagggggatgatttgcagctaatatcagtgatgacaaaagtattctgcactaaaacatttatccatctatgtttaaaaaagctattaggaaaactgagcagtgatctgggttttgttatgttccttctacttttaacctagtttcctccttggccttaattcccccacatgttcaatggcatagaaatagacaaaaaagtagttaatattatagaataaggtaactgtgggcattaaatgagatggtatatgtgtctggcacatagtaaacattcaattaatgatattgttgttcatataatgagtagtagtattagaaatatttgcagtaatatctagtgttaccttcaacactaggagcagaacagtgcctgggagtgctaattctgacaaattattcagttcctctgagctttccttcttgggtctatttcccacctctggctggacaatgtgtttaatgtttccaagccttaattttaaaatttataaactggggataatatttgtatcaatttcttaaagttgttttaagagattgaattactggcaggcagtaataataaattacagtaatgatgactattataattattgcatacatactaattgaggtgttattctagaatatttaggagtgaggggtctaacacagcactttctgagtttgaatcatttttctgactcttgttagctctgtgtgaccttgggcaaagtgcttagtctatgcttcagtttcttcatcaataaaaggggaagagcaatggaacctactataaaatgttgtcaggaggttgaaataaaataatgtgtataaaacatgtaaaatagtggctggcacatagtgtttaaaatacttattattatatcacttattaaaatgttctttgagataagtatgattttgcccattttcgatgggtacattgaggtacagagaagttgaataaactgtccaaagacacagagtgataaggtttggctgcgtgtgcccacccaaatctcatgttgaattgtaattcccagtgttgggggaggcacctggtgggaggtgactggatcatgggggtggatttcttccttgttgttcttgtgatagtgagtgaattctcaggagatctagttgttaaaagtgtgtagcactgcccccttcactctgtctctcccactccaccatgtgaagaagctgcttgctgccccttcacccgtccatcatgattgtaagtttcctgaggcctccccaaccatgcttcctttacagcctgtgcaactgtgagttaatcaaacctcttttcttcataaatcacccagtcttaggtagttctttctagcaatgtgagaacaaactaatacacatggcgagagtaattctgtcatttgaaaaaatctttgtcccctaaattgtacccagctgcttcattttgcaggcacttcttgctgttgaattgctaattgtgggatccactagaaaccacagctccctgaggaccttttatactcttcctgtttggaattgataggggaataaaaatcatcttttggaatagaatttgagacaataactgagctttatagtctctcatttcctcccacacaacttatgatttaatatcctgaatggtttgctattccctgaatgaagtctgaattgccaacttctgtgtttttgcttatcctatccccactaaatgaacttgccgttcttcctcctcaaccttctctgtctctattctctaaggctcatttcagtggggaaggggcttcacagaggagaggcctcctgagacattcacacaccctgtgcacttgtcacctctgatggctttgtatatcaatgatctctttgaatatctgtcatttcctctgtgatataaacatttagaggcaagagatctatcttggttatcttattaccactaatgcctagtatggcctgggcattagagacaatttattcatttattcattaaatattgattgagtgcctattatgacccaggcattggtcaaggtacaatggacattagaatgaacaaaaacaaccaaattctctctcccatgggcctgaaattctaatggaagagtcaccaattggacatcggagtggcaatgtcaagtggctggatggagacatggttctgaagttgataagcacagtctggctgaagatgtgaatatcagagtcatcactatataagtaatattaagaccatcaaactcaatgtgatcactaaggcggtatacattggcagaaaatataacagtaattctttcttttatggaatgaaggaatacatttaaaaaaaaaaattaaaagggccagggagtggcagggactccagagtaggaaagcccaaagcaggatcagcctagaaatgaccattttctaagaattacttttcctgtgggtttcctctcctggtggcatgtcacagagcttcctgttcatggtggtattcaccaacaagaaaataactgagcagcatggctgtatttaacattcattcaacacagacacagtttccacatggtctttacatattcttcatgtcttcaaacatttgcccagggataaacagtgtctctctttgagttcttttttcctcttagtccaggggcagcttgcatgtaaacatggcatccaaataatgatgcctaaactcatcttgatgtcaccaagatgtggcagtcatgtggcaaaaaatcataaaatctcccacaacattattaagtgaaaagagttggaagtgagttcagagaactcaggaaaaatgctttgcaaaacaaagcatgaaaatttactgtccagactctgctccatttctcccattagagtataatctttcatagtgtgtggtatatcatagcgatgaatccacatacaggatttctgtaatgatatgatgattttgacactgatccttctaacatctgctcacctaaagcattagtttcacactgctattgaaataaatgtgatttttaatatcctcaggaacactcaatgaagaatatgtccacctctaagcagagtctgaaaacactgtaatatgctatgggattgtttttctccccagcctcaaaggagaatggtttgctgaaagataaataaggttttatactgtcagttcatctccagaactcatcttttgttcttctacttcctctttttaatgaaaccttacaaataaagatggaccaatattaccatcaagaattgctgcctgtcacacttggtgcttcaaaacccttggcaaaaggcaatttgaaatgtaagaaggctaaacttgaaccctgcaatctaagcagataaaaaaacaatgctctgtattttatagacctggtggagtagaaaattgaggctctttgaagaattaggttcccatttcagcagaaaccagactcatcgaccagactcatgtttagctcaaatattactttttaggccaatgaaaatggaaaataggttgtatagctcctacgagaagctaccttggttaccattatgaaaatattacataaaacaaagaaggctctcatttatctaacagtctacacagtgttttgtaagtagtcatcattctacccattctggcccaaattaacagtaacaaaagtggaaaaatcaagtgggaagcaaaagacttaatcacataggtaacctgaaaaaaacaaaagatgcactaatcaaaaactaagcttgtttaattcttgtttcaaaaatttgtgttattcaagtatttaaagccaagatgtctaaaataaaactaccatctctccctaactgaccttcatggccttccctctatgttccttatcttgataaatttcaccattatcattttggtggagtcacttcatctctttcctatctttcactcaatatcacaaattgtttttcaatatttccaattacgcacaattccaccatgtgtttcaaatttatcctctcccttccaccacgattgccatgttttgacttttgtcatctcttgtaggcagggcagtctagtggtaaagacactaagctttggtattatgccattgaaggtaaaatccctgctttgatgtgtcataattgttaggtgctgggtgagtgatttaatttctttgtttagttttctcttttcagtggaggttgtaattgtaccttcctcacagacttgcagtaaatattaagagtaattgttcaggcttaaaatagcattatgctcaagtgttagctattgatactgtcttgcacagacttttcaagcagtttccaactaattttcttgtcgtctttctctttctctctcaacaatttgtcttctgacttatttttggtgttattttaccactgagtttcagttggttcattgattcagaagccaatatcccactaagtttggttattagttttgacacctgtctgtctcttgtcttcaaatattgttcttgatcctttgctagtcttttctctaacttcaagttcacatcatcccttctaaaatttggcacatatctagctccctctactcttggctgaccagccatccccaagtgccagacaagatgaaaaatcactcctcaacttaaaaacctaacttaaaatccccattgcctctctgcagagtgaatgcagcatagtgcccaggaaagttttcaaaatctggccccagatcactttgctggctgcttctctttcatacttcttgcccctcctgactggctaagctttatcttttgaagtacctagaatgctcctcctttttttcccctctgatgaaatgatgattcttctccagagggccctgctgaaatattaactctttgtgaaatgcacctaggtgagattgaatttcaccagtatcactacagtagttgtgatcatcgtagtagcaggagaatgacagcaaaaacagccaacatttagtgaccatgtattagccagtaactgttctaaacactttacatgctcattaatcctttgagcaaacttacagattatttactatcatttctaccttatggatgaggaaattgaggcccagaagggataagtagcttaactaaagtttctataactagttagtcacagaatgaggatttgaaccaaataggctaatcccagagttatcacgttcaactttttaactctagtatctctctagttttgcctctcacagcattcacagcactttacttgtattcgttgtgtcttagatctacatatgtgtctgtttatttcagtacaatgttagtcttcagatgtagtgatctgagtgttcccctgtgcctggaactattgcttttcaaatagtgttccataaatgtctgccatattgaagtgaaattcattaaatttgtcaacagaaaacaggtgtcctgacactcctacctctagctttcctatactaaaacctgtgaatgatttaatgacaacttctggtagatatataatggaccaggaaaaaaaacccgcaattttccttttttcactaagtatcaatgtgactttgggcaagccacttcatctctttttttttttttttagtttggaagatagagattataacccttgtgatctgccattatcaaaggggttttatgaaaatgaaatattcaaaagaaagaattttaaaacttgtaaaagcccatacacgtgtaagaaacaaatattctaataggtaaaacatatagccaatatctgaacgatagggccaattggtattacagcagggttaaatggagtttctaatgtttcccatgttctgcctttcatggacagtgaagtaccacaaaaggaggaaatctgtgttagctttgaaacctccaccatttgtcacagccagaaataatgccgtctcaatggctgctgcaatgctagatctggaaagagacttgggcacagtctctacttcttattcgtggatggtgaaaggcccagagagaaggaaaaaaaaaaaactcattcaaggggctaccaccatcttcctgcacaatatgtgctgtgtatgacggtcccatgttgagcaggtaagtggaaaaagatctagtcatatttttttgtaaaactgaccagaacgttgaacgtaactagagaattggtaaagtacagagactttgcagctccactgctgtgttcaatctcttcccctactcccatgcctcttgctgatgatgtgattcagaaattaaataatccctcatacctcagtttcctattctgtaaaatgggtataatcctgtccaccttacagagttatttttaggatataatgagttatactgtgcaagccacttaaaactgtaccagacacatagtaagttctaaatgtttgttaaatagataaaaataacatctgagggtttgaacatgacacttttagggcttaaaatgaaattgaatgaatcttgctttctattaagaaatacgtaaatattaaatttacatttaacatgggttatgcctctgttcttccacagattttcctgactacatgcctaggtcagagcctttagctaaattcaccaaggagttagcatgagattaattaactgtcagaggttaaacattaaaaaaaaaatcctggaggttactgttgtatttttaatgggcaacatgttggccattcaagttgctttttgcaaacaaatcctccaacagccaaatgctgatggtttctctgccaacagagcatctaaaaatttctatgatcaatatgctaccgggaaaaacaaaacacactgaaatgttatggtatatttcatgccaaaaacctgaaacacagttaggaaattatgttttgcagttatgcaaggcaatgtactgatggtggtttattgatgagtggtctagtctcaccataaccttgtcatattcatgctcccatttctgctcaaataaaaaacaaaaacccctggaatgaagctctaatttagtgaatcaattattttgattgaatgagggcactgagatagtgctgggtagatgttgttatgagttaaatttagataaaaatgtgaacacatacaaatatacagataatcaagtgttgaatgttttatcttttgtattatttcctgaccattatctagtaagtgcctttttgtcaaataatgtccattgaatgagtaaggaaaatgactactttattctttggtaaaagaactggggcatagagagataaagtgagttactcagagttattcaataaggagttatagccagagacttgacagcatttattctttctttaaaaaagtgtttgtgcttacataaagtatagtagctaggaatttcttgacattaagtcatccataaagtagctaaatcccttaatcctgtaaatagctactcaatatcaatgtacattcacgagccagctgtcagcctccaagatgccacggaattgggaagaaatctttttttttttgttctgagatggagtctcactctgtcgccaggctgtagtgcagtggcacgatctcagctcactgcaacctccacctcctggagtggagttcaagtgattctcctgcctcagccttccaagtagctgggactacagacgtgccaccacgcccagctaattttttgtatttttagtagagacagggtttcaccatgttggccaggctggtctccatctcttaacctcgtgatccacccacctcggcctcccaaagtgctgggattacaggcgtgagccaccgcgcctggcccatgaagaaatcttataagaggagtgtgactctaagtctgactgactcttagtgtgactgactctaggaattgtcgctgatcctgtagatcacaacacctggctcctaagatctacagactctggaaaacatcttccatcatttagcctccttctttctaaatgctactatggttctggaaggctgacctttgtggacaatattatctggactccttgcccttctggtttcccattgggtttggccacgggtgaagaggaaaagggagaggttgtggtacttatcatctgggctcgctctttggtgagttgacaatagctgcatttcttatccaaggaccagagcccttttttattgttacagctatagctatggctttttccaccttctagtaaccatcaacctagaaatcgtaactttcgttcttgctaacactgaatgtttcatagccttattggctcaataaaccctgcgcatacctttgcaaattgtcccttcattcaactatcccctgttgccctatttaaatatgcctttttttccttcctggaccctgactgatactgaatcatagaatttcagtgttggaaagtactggatttggagttgagtttctgatttcagatttttttcagaagctctgtgattttgagcaaataatctcccttgtctagtcttcagtttcctcatatgtaaaatagcctatattccttatagtaggctattattattactactattgttataatatgctgtaaatcacttaaaatgtgatgactatttctttaaaaaccatgtagtccaactggctctcctgggtgccaaccgtatgaaattttcttttcctctccttgaatttttccagtaagttttcttctatgggtatgacagtctcaaatcttgcagtcagacagtaagcgtatctgtatcactggagtaaggttcttttgggtataagtttttgtttattcaacttctcagttgtgggattctgctcaaatcattataaccttttcaggccacagctacctcaattgtgaattgggtaaaacctatcctcctgcaggcaaagggccagagctaatgttttctctctctctttttttttttccaatttaaagatttacattaggaaaaacagctactactctagacctataagagctccctcaatcaatatcagaggtcatcagtggagctcagcctgctaaagtgatgaagacagcaggctatggagtcagaattctagctctgccaactggggcatttgttttgtttctatgtgcctcagtttttttagtcattctatgtacctacctcagaaggtggttgggaacatcaactgagttcatacttgtcattgattcatgctcatgatatttcctatactaaatactttgcatggattattcccatgacaatccattttctgataatcgtaatcttttttgtctccaataaaccatggccctttcctccttctaggacactctctccagaccttcacattactggctttccttttattttaaggacttaaaagacatcttgtcaatgaggctttctctgagccaatcaagatatgtcccctgcatatattccctttccatcatattaccacaggtttacttctgctataacacttatcacttcccagattacctttgttttcttgtttattctctctcttcctacataagctccaggaaggtagtaaactgtgttccactcttcactagaaagtgagtgtctagtatcatgcctgccctatatggtctctaaaaatattgtggaatgaatgaccaaataacgaaattaagaggtggagaatttatgtaaataagtttacagtaataaacaggcattttgtttagtatgaggcacaacaggaattcaaacacatgccaggatgatgctaaaacccacaatgcccctctttgcctctttcaatagttcttggaagagatcataaaagtctgagctggctcagagctgtagcaaaagagacaaaaaaaagtgaaattaaaagatattcagagagaacactgaccagagtttagtagccattaagatggtgggtgggggatcattaagcagagagaagattccgacttcagcaactggacagctcttgatgccaatgaatgatataagacgctcagagtgagtgctacagagtgatggtgattaggagactacatctggctgtgcattcatccgcatcctgggatggaggttcaaagagctgcgggcaattgactgcctaggggatcgtgggatgggccaaaaatgtgaacaagacaattctttgttcacagccaaggtactgctgactctatccctgtctcatttcttactctggttgaggcgatactagtgtcaggtggaagacattctaaggcctaaattaattctcattagatgatatctattactcttgctcaactaccaatcaggtagctcgatgggagaaggccattggctatggcatagatctgtcacctcctgtcttgaagccatgtgtgttgcttcctggtacatttccaagacaatggcgctttttgatatttgtctgatagtcttctcaaacatcaaagtcaagatatgtggtttatttaacacagtagtttgggacttagaagttttgcctttgacattttaaaaatgagaaatacatttaattttcaaacatttaagaatgtctatggttcttcatgcagaaaatctttgtcatatgctgcttcttttaatgctttcgtttgaggcacaaacaccagaactaatagtttaaatctgtatttaacaaatgactataaaaggtatataatttcgaagtattaagaatattatgcctaaataacaacagaactcaagaagaaatatgtatgctttgctgaaaaacatttgaaaggccaatttgtggaaaaattttctaatataaattgggaagcttgcattcagataaatcagttcttttatccaataattcaaaatttaggggaaagtaattttaaaagcatagatagatatatacacaaagccatttatcatggtgctatttatattgagagtgggaggtaaaaagaggaaaactctaaatatccaaaggcagagaatgggatcaaatacaatatactagagttatgcaatgtagtattatgcttgccattaaaaatgattttataaaaagttttaatagcagggctgatatttatgaaagtatatcatgtaaatgaaataataaaaatttggtattgatatgacataattagtacatatacattgatgggaaaaaagatattactagttatttgtagttacttcatggtagcagattatgtgtgtgtggcgtgcacgtgtgtgtgggctcttatctttctttgcactttccaaattgactgtcctgaacatgagagacttttgcaaacatgataaaccattcacctttccaaccctggaggagaaggcgaaaaaggaagaggagaaggcaggagtcttatggggtccacaaatcacgagctaagtctagcgtaggttcagtatcagccagtactatacaatcccattagtatttaaagtgattctgatcatttttttagtattttctattttttttcctctcaaaacatccttttccctcacagttagttgaaaattgcattgcatcctctgtgaacatttatttgggggcatggctttatcagacgctggtgcagaagagtgctaacgagacatgacaattttctacttctctacgtgaatacagagatccatttgaaagttacattttacctatctacagtgtacaaatgactatattttcagcaaatatctaataaattggcaattttgattccaacctgaaaggagaaaagcaatgactctaataaccaacaatctttgacaaatagtggcaataaaagtgcctgcagcttcaatatcatgtaggattagggctctggcatttttctagattatggtcttccaggttgctgatgatgttatgttttgtgagatggtgtgcatgtgtgtgcaatgaaagaaaaaaatcacagcaatgtatctaaactataattttaatttttgtatgtgcattggcttagtgctaacgaaagttatttagttctgcctcctctccccacagaatataatgtaagctctaatagaagagctttctttgttttgttttgttttggtttggtttttaatctgttttagtcactgctccatctcccagcacaagaagcaggcagtgacatacaataaatatttgttgaatgaataagcaaattaattaaatcttattatgatgatatatcacctttggtcagtgccattgaaacaaattgctattctattctgggacttttcactgaatgtattatgttgtttgtggttctttccatattttctcatttgtgttgtggagacccatgacattttagtgcattcatatttttaaatcactaattgaatccatgagttcctacaaaatggtgtagcagtataaaaagcgagtaggtggagctgtgggttatagccccaatactcagggaattccacctagatttttaatgttgcattttctcactagcaaataacaccaccttctctgtctgattctaagagttgtttgatgcttgaaaaaaattgtgtataaaagaaagtttgtacacagagaatatttgtcaatgtatattctaagttatatagcatctttataaaataagctgaggatttcctttagatattcctctattttctactctttaagaatgccacaaaatagagaaaaagaagatggagaatgtgatggttaacctcacttgtcaagttcggcaggctatagtacacagtgatttaatcaaaccctaatctaagtgttgctgtgaaggtattttgtcgatgtgcttaacatctataatcagttgacattaagttaagcatagattaccctgaataatgtgggtgggcctcatctaatcagttgaggcttcctgaagaagaaatcctgcctcaagactgtgacatcaaatccttcctgaacttccagctgccagcatattctatgaatttcagacatgccagtccccataatggtgtgagccaattccttcaaataagtctctttacatatatgcatatgtacatgtgtgtatatgcatgtgtatgtatgtatatgatatgtatatgcttatgtgtatgcacatgagtatgtattggttctgtttttctagagaatcttgactgatacagggaaagaatcaacaaagaagaaaagtcacgtttatttaaatgacactttgtaatcttttttctaatctagtgatatttctgaatttgggcagtgtccactgggattatagacccagtggatgagagtcaaacaatgtacaaggtcatatgttaaagtgtccagctgctctgctaacaaggcaagcaataggaattcctacagttacttgagtccagtccccatcccttacatcaaacaaaaatgtcccagtgttttgcaggacaggctcctgtcactaagactgtgctgtcagtctgcaaaatggaaaatgactcctaattgcccaaatgttctcctgggtatttaggtaaacatgagtacatcaatagattgcttttgtagaatatactgattctttgtagagaacggcaatgcatgcaggcctaaagaaacgaaacaagagtttcggaggaaaaaaaaaaacaaaaaaacaaacttgctttgaatagcaggagacgacgttttggcagctgagcagggcaagagcttcatgagccgctctttaatgctgcgcttggtgctgttctgagcgtacaggaaacctagaagatacaggatcagttctgttaatgctgtctgcagagagaaaagggacgtgctgcagggtttatcagagaagccaggcaggaaggatcagggacgcagccatccactcaggcaatcacaggcagtgggttgggacccccgaaaggaaaaaaaaagtttgttttcttcttatttagttttgtttttatttctaaatgttgttttgaagataatgacgaacaagtgaaagcagaatcgtaaaatatatctattgaacggcaaaagattaaaaaaagccaccaaaaaaatctggtggtttttttttttttttttttggcccttagatcagggataaaacaagtatcactagaagagttaactggattgaaatttcaatattcaaaccagcgctaagggcccacatgacaattttctgctattgctccccatctttgattatagcagagatagatgcttcacataaatcattcacaccacaatcacctgttagtacctttgccttcctgaaaatgagaaaataaatgtccttaatatgcagcttcattagcatatactgacatgcccagagatgtgacaatctttcccattttttacatgtggacgctaatgaatggaactttttcaaacagactaattctggaagaagccagacaagcttgtcaaacattaacccaggaatagacggagcagtatgtgtgacagcagatacctggagatgactcaagaaaaatcaaaagtggctggacgggtgagcttgcaaactgctgaaacaacttttgatgtcaggagccaactatccaagtcagcatcaatttacccaccctgaggtctcagacacttggatgtcatgttaataggtaactagcctccccgagatcagcatgcaaggtgtcaaatataaagcatcagcgcagaaaacaatttaaatcgaggttctaccatctttataacaggaatctggcaaatgtatcacttgttccttttctagttcttatcttggaattataaaaaaattcctgaccacaagcctactgatttagtttcctaaatcatatgttgcacccaccaacagtatccactggctaaaactcatgtgtgtgtgtagagtaggatgacaaaatgaagtagtaaatacacaaattaaataagatcattcctctgattaaaagccctctaaaagcttcatgttgtttttctatcgaggacgccaagtatgatctggccctgtctgagtctctggcagcatttgcagccactctctctgctttctgggccatccactattggccacactaccctttttgcctttggtagaactcacaaagcaggccgtcctctggccttgacacttatgtggtatgaaatgtctcattcaactgctggttgagggtctggcatgtaacagaaggtcaataaatgcctggcaaatgagtaaataaattcactttggatatctaaagaagacttgattcatttcctagattagtatctaagtaagctttttaaaaattttactttaagttctgggatacatgtgaagaacgtgcaggtttgttacataggtatacatgtgccctggtggtttcctgcacctatcagcccatcatctaggttttaagctccgcatgtatgtgtagagtggggtgacaaaatgttataaatgtccttaatatttccctccccttgacccccaccccctgacagacccccgtgtgtgatgttccccttcttttaaacttgcaaaataaatctggtttacataaaacacaccctatattttgcttctgatttccatttctggaaggatgcaacgatttaactaccctctcctttgcaaactcctccaggacatgagggtcttactttagctccctacacaggcactctgctcctcccctttatgccatttcaaacctccgtgccaggatatgtgctgttccctcagttttgtcagctgttcaccaactctcaacttctgtatcccagtgcagccttttttttttttttttttcaagacagagtctcactctgttgcccaggctggagtgcagtggcgcgatctcagttcactgcaacctccaggttcaagcaattctcttgcctcagcctcatgagtagctgggattacaggtgcatgccaccatgcctggctaatttttgtatttttagtagagacagggctttgccatcttggccaggctggtttcaaactcctgacctcaagtgatccacccaccttggcctgccaaagtgccaggattacagacgtgagctactgcgcccagccccatgaggcttttaaaactcagttcaaacacaccttcctctggccatctttccctcttgtgtctccaacttgcctaaaagaagaaagacctcctccctcccctgcttcccaagctaactttgggagaaatttagcttatagtttaaatgataatggcccttccccaaaactaaactgcctttgtaaagctaatgaaagatcaccaggttaggaggatgagaggagcgtgaattctgctaaggtgtagccataagctattaccagccgttattctcgaggtcatgagattcataacttccccaattactcctgcagataacatcactactgtagaacctaagattggctttttgagatgtcttttcaggtttttgcatttctgacaatgaatggcttcgcccagacctgccaaccagtcctgtgaccctacccagaagccaactcagcatgaggaccattttccatatccctaggattgcaccccaaccaatcagcagcaccctttccattacccatcaactatccttgaaaaaccctagcctctgaattttcaaggagtcttatttgaggaataataaaactccgggtctcttgctcagctagctctgtatgaattaagctctttattgcaatctctctgtcttgataaatcagctctatctgggcagcaggcaaaatgaacccattggacaggttacagtatctgcttcaaaaagttaggatcagaggaaataatatataaagcacttatcacagtgacagccacataatgcagtccaaacaaatattaatcattttgtttcacttatttgagtataccctattccctactgtctcagggccttttcacatgctattatctgaatctaaacttctgctttactttctcttcatctggttaatgcctgttcatccttcagatttcagttcaataactttttgaggaaaaccttatagggcaaaccaactagattatgaacagttattatagatgcccatagttttctatgtttctccatagcaagtataattaaaacaattcatgatacaattacatatttgacacgtcttccctactgaaatggaagatggaagatgtctacttctagcctttacagaataaatgttactggatatgctataccactgtaaggaaccatataactggacaagctacatgagggaactctttccaagaattgaacaataaacaacatagaactgtgatgcttgagagaagaaaaatcccagaggtgtgcttcacaaatgccctggctcgcccctgcctggtgacatgttccttccatagttcagggaggtagagctcatagtcactgagctgaagtggcagagattagagttccaggctcctgaagtggctggaatttgtaggccagggttaagagagaattgatgtatgcgtgtgtattctgcaggtagctggtgggtgggaaatttgtgtgaaattaaatgtgggttattgactaagggctgggatatgcacgatatccaaggcttcccaatgcttagcaggcagggctgagaatggaatgaaataacacaagccacatagagctggaatgctgcaagttgttagagttctagccctgccagccttccaaagaagacttcactgagcacctctggcgttgccctgagaactcagaaaaaccactttgggagtaaggataatttcctagagtaagggccatagtgtatcactgaggtaatagccaaagttgactgatcctaacaaagaatagacctaaagctagaaagaccaaaaagagctgctgaactgtagaatgcttcgaaacaatattcaatatattttaaaagaaggcaacatgacccaaactccttacaatgtatcctaataacatcttttgtactataaaaaaattactagacatgtgagaaagcagaacaaatgtgacccataatcaagaaaaaagagaagtcaataaaaacagacattaggtagcacagatgttggaagttgtaagaaatgacgttaaagatagtcataataagtaaagaaaaaagttcagaagagaaattaaactacaaaagggaactaaatgaaaattctagaaataaaaagaaaattctaaaaggaaaacttcattagatggacttaacagcagactgagaactactgaagaaaggattatgagcttgaatagagatgaaaaggaagaaatctgaataatagaaaaagatttaaaaataaagagagctttactcatctgtgcatcatatcaaaaagtccaacataggtataattaaagaacataatgagaggtgagataaaattttgaagcaataatgaccaaaatattccacatatgttttaaaacacaagtgaaatctgttgaaccaaaagaagaaaacttaaagtataataaataaataaataaataaataaaagaagaatcacacatagctgtaggcaaaatgctgaaaatcaaaaatgaaaaaaggctttaaaatgaaaagagaagaaaaggacccgtacatacaagggtcaaataatgtaagaataatttttcatcaagaacagcagaaacaccagaaaacaatggaagagaatccttaaagttctcaggggaatacagagactatcaacccagaattttacctatgtttttgagaatgaagttgaaataaagatacttttagataaaataaacctgggataattcatagctaaaagccttgcattccaagaaatgctaaaggaatgtcctcaggctgaggttaattggcataatacggaaacttgactctacaggtagaaatagagagcacaggaaattgaaaatatgtgaataaatatattatcctgttttcctttcctactttctttgtttaaaacagcaaaaaagtattgtagagtttattacatttgtagatgtaaaatttctgacaataataacatgaaagttgggggagggtcaatggaattttaatgtatgatgcttacattttacatgaagtggtaccatatgaactcaaaatagtctataataaatgaaggagacatactgaaatctctagatacaagggaagcagtaaaaaataatataagaaggtatagtcaaaactccaatagaggaattaaaatgaaatatataaaatatttaattaatttaaaagaaagccagggaagaggaatagagggacaaaaagtagaagggatgagtagaaaatacataagatagtaaatgtataccccaccatataattaaatcagaaattgtattttttattcattactgaattcccagtatgttgcacagtgcttagtatataaaatgttcaatcactatctactgaaagcatgaaatcagactatatatcttttatgattgtctcagtatgtgcagatttgctacttgtaattagcagatgcatttagaatgtacatatatgcttcctcacagtgtgtgaagcgatccctaaatagatagctgtgtgtgaaggcactctcttaaggatgatactgacagaatgaggaggtgggactgaattccccagccaatcacactaaaagaaagttgatggtgaatctccaaactgccttagtatgtaggacatttaccctcacagagactaaacactctttgttttcattaatttattaagttaatatgtatcgccacctacaatggacagattcatatcttaaattaattggctacataaaccactgagcctaatgagagcattcaaaattaagtcaaaataatcctagtttacctcaaaatccttgtctttctccaaattaagggcctggccagctgtcataaattacatattccttttggtttttttaaaggttacatgttcaagagagtgaaaataagatgttctgtctaaaggctaccatgcctggtttgtaaatgaacctgttaaatgctgtatttgctcccacagcttactacagaatgttacttaatacaatatcatacttattacaatttttactataggagtgtaacaggtaaaattaatctctattttagtgggcccatgtttagtctttcaccatcctttaaattgctgtgaatttttttgtcatgacttgaaagcaaggatagagaaacattttagagatatctgggtttttttccattccagaacttgtgaggataatcatatttgcttcatatttatagtcatgaactcctaagctggcagctacaaccaagaaccaaaaaatggtgcattctgcttcttgtaattcatctctgctagtaaattataagaagcagggaaaatattttatttggatggtttctataaacaagggactataattcttgtacattatttttcatccttgctatttctttgagcagtctaatgtgccacataattatctaaggtatttgttttctataagaattgtttcacaagtattcttgttatcagagtagttgtattatatttcaaaatgtaagatgatttttaaaagcctgagtactgacctaagatgcaactgtatgaactctactctggagggcggggagggtgtcagtggaagtcgtaagacttttatttttttgtgccatcaaatacaggtaaaaataattgtgcaattctgctttttaaataggaactattggcctgcttggccctaaatggaagggctgatattttaagttgattattttattgtaaattaatccaacctaattctttttaatttggttgaatgtttttcttgttaaatgatgtttaaaaaataaaaactggaagttcaaaaaaaaaaaaaaacaaaattaagtcaactcccatacctctgcatctagaagtcaaaccaaactgctagtatactaacataacactttaaagaccataaaacaaagcaatacaaaaagagatgaaaaattacttttcatctcataaatatttgtccaaaaagcattctttataatgtacatattataagcattataaatgatgttctttgtagaactgtaaatatacagtggctacatagaaaaaaaatccctgctgtctagaatctaaccatctgcatctattataatacctatgacattgcagatcccgaattccctgaggggaggattctgtttgtttatgaattaactcatttaaaagcatttgttgaatgctaactatgtgctaggaactgtctcagatgctggcaataatgcaccgaatgagccagccaaaaaacttctattttagtggaccttacacgatatttaggaaagaaaaaataatcaacaaaaataaatagcaagttataaagtatatcagatatgaaggagggatggggcctagagacttctgttggtggatatggatatgggtaagaaataggacggggaaagacataattttaaatatggtggccagggaaggtttcattagagatatatttgggcaaaaatatctacataagatgaaaaggtgtcttatcctgtttcgattattaacaataacagtgtattacatatattaggtactaatatatatttgttgagtgattcatatcacttattaatttattaagttaatgtttattgctacctacaatgggcagattaataaattagttggctacataaaccactgagctcaatgagatcattcaaaattaagtttactcccatatctctgcatctagatgtcaaaccaaactactagtatactagtacttcaaacacgataaaatgaagtaatacaaaaagataataaaaagtaagtgtgtaaatatataggccattctaactgtgctctaactaaatgagaatgtattcatttttaccaattggaaaggttttatcttataatgcctgacattactgaaaacacgtcagcctatcatcatcttgattgctccatttttctggtcatgcagacctcagtggtggcatatgcaagtggtcattctccactggctgctttttgtgttacacaggaaatgccatcacatgtcagtgtcatgtgtcagtgctgagcgatgggccatgaattatgaattcaacaagtactgacagtggcaatgaaagtggtaatttcaccataatgagaactattcttatcttcctcctttttgcagtacagcagatagcaaaaacttctatttctcatgggttagcttggaaataatggctcgtactctattaattcacagtcccgatcagcttctattttgtacttttgaaacacggacaatgtttttcttcctagattttaagcctgtagaagtctggtggaagaaaatggcaaataatgtttctacagatctggtgtcttcccatgaatcaataactatgacaaaaattgggctgagcaaggtggctcatgcctgtaatcctagcactttgggagtccgaggcgggctgatcacgaggttggtagatcgagaccatcctggccaacatggtgaaactccatctctactaaaaatacaaaaattagccaggtgtggtggcaggtgcctgtagtcccagctactcagcagactgaggcaggagaatcacttgaacccgggaggcagaggttgcagtgagccaagatcacgccacggcactctagcctggagacagagtgagactccgtctcaaaaaacaaaacaaaacaaaataaaaatcaccaggagtttcaggggtactgtgatcccatctgtgttctttgagtcagtgacaagctgattcatcagtagtgtcatggatgctgggaatagggagtacatttttttactagttgcaaatatgaacttatttattaggtttgggcaaaagtaattgtgatttttaccattgaaagtaatggcaaaaactgcaattacttttgccccaacctaatactatgatgcctatttttaaagtggacttacagttcataaatactagcatgactacacaaacaaacacatacactcagaattcatttagtattttcaaattcattcctgaagatactaggccccagataacttggggttcatatgctggtaataattcttgcagaaaattgctgcccaaccatgcagttgttattggatcttgcagtcagccccaaatcattcacttttaagagaagtagcaacagtgttgctgactgaatatgaggaaaatacctacatttcattttttaactttttgaacttgggaggcagaaaatgaccttcctaattgacctgttttgttatgcttgattataaaatagtttgtgtatcagtttaaaagaaggcaactagaaggtgcttgaatttgctgaaaacgatctacagattccaaatgcaaatggagtaaatttgactctacttagagtggctacctaaatacacctgtttctcataaaattaatgctactctctgtcagcctttccatctctctatctgtctttctgtctctgtctcactctttcttagtctttgtgcctttgcttttatctttgtctctttgtctccctcttcttctctgtctctgagtttctctggctcaatgtctctctctgtctcattgttctacatctctgtttgtgtctctcctttatctttttctgctctgtttctgtctctaccccgactcagtctctctctcaatcaaggcagggtcctatttaatcttctttaccttggtgttgactgtgttcttaacaaaacatttagagagagttttggtcagttgagtgcagaataattattgcatgttatctgaggcaaatattagcaaacaactggatggtcaaaagctgtaatgctttctaaagccgcttctaagtgtgtttgtttttatcacctctctgctgtactggcagaactagccagagaatactagcagaaaacaacatggaaaaggcatcaattttccttgggatcttttaagattgaccaattgaacctcaattttcccttgctcctctgaacaatttgccaaaactacttctacagggctatcctttgtgtggggtttggaaattatctggagttccttataaatagggtgacaagaccttcgtttgtccaggatgctgccagtttatgggagttgtcctaacaccccatagtctgcacccccttttcatgttcaaaaatgttcttgtttaaatggtaaattatatgttcatgcaatattagcaaccagtatggtctgttccacagactaaggtacagtcattgactaagtgaatacttcattgcactgtaaacaatgtaaataatgcaatttcattttaaaaaatggtgttttaagaatagctaaattaatagagaaggtgaaataggaaactaaaaatgtttttgtgagcacattaaagctaacatttatgatggaaagatttggaactttagggttcagggagaactcatttgaatctaagcgctgccactttttgtttgtaaggcttcggaaaagtaacaacatcactgagcctctgtttttttttgtttgttttgagacataatctcactctttcgcccaggctggagtgcagcagcttgatcatggctcactgcagcctcgaactcctgggctcaagtgatcctcccgcctcagcctcccaagtagctgggactatgggcacacaccaccatgccccagtattttttttttttttttgtagaaatggggtcttgcgatgttgcccaggttggtcttgaactcctgggctcaaacagtcctccccactcagcttcccaaagtgctgggattacatatgtgagccacctcacccagccaccttgcctctttgatctcacctgtatatgaggtaagcagccaaagcaaaaaggaatttatcaaaaatgacagcagtatctttttggatataacctaaacctaatgtactatttcttttccgcaagctaacacaaataactcttatttatttttatattttttaattgagtttttgatcagtgagccatgatcaagctccatgctggagtacagtggtgtgatctgggctcactgcaacctccacctcccaggttcaagcaattcaccttcctcagccaccggagtagctgggattacaggtgcctgccaccacacccgactaatttttgtatttttggtagagatgggatttcactatgttggccaggctggtcttaaactcctgacctcaagtgatccgcacacctcggcctcccaaagtgctgggattacaggcgtgagccaccgggttgaagcatttttaacaatcaagcattgtaacttcaaacttttctttgggataagccaagcatgcctttaatatcggaaagcaagcgacaggtgagtaaggttgattcttctgatggcgagagaacacaaataaattgattcttaataggatttgggattacaaggtgtattttcgtgttggagtgtccattatacaatgaatcttctcctccaatgtcacccacagtaactagtatatattcttaggtattgtctaggctactctgttcattttatgactggcccatcacctgaccactgccttttaataacatatttgaagggattttcaggaaaaacagtcacttgtttccttttgttcattctttttattttctcttagtataaaatcctgcagaatctcatagtctactctaagagctttggcttctactcagagtgaaataaggagaaaacggaggaggattttttagcagaggaatgatatcatcatataatgttttattcaacaacattaattaagcacctatttggcactggcaaaaacatagtccttgctcttgtgaaatgtataatctaatggggaaggattaacaatagaacaagaaatgaattaaacaatagaacaagaaagtcctctaaatttcatcttgaacatgatcttgttctaagaaaagatgcagacaaataatgcctaagatgcaatgctctaacaacaataagaacaaagagaaccttctatgtgctaagtaccttacaagcatcatattatttaaccttcacaagagccccacttgtggaagataacattatgaaagccaaattatagcagaggaaattgatggtaaagatgcacgcagtttgtaagtggcagtatcaggaatgtgaacacttgttcatctgtctagctcctgggtctgacattctgacttctgtactgcactaacaatggctccacaaaatggaacacttattggatgtgtctaattgtgtagtttctagctgcagaaaatttgtttctctttgtggtatggttttaatttccttctctgcctctttggttaagcttcttaacccatcttgtcttgaatatagtcctgagagcatggtgtctttcattcctttgctagaaatgctacctctaattctatttgcagtaggacatccatcaaattcctggtggtattaaaaaataataatgtggtttaggagaaagctgcactaggagatccaattttttcatctgaaaaatggggctaataatagatgacactaatctcaaggaagttgggagatgaatgaagtaattgtttctgcaaaatgcttcaaatgccagaagaaataacatataatccattataatttttgatgtgagacagtactttcctttcctgagttcttttgtgtcactgtatttaattttcatcttttaacaatgtatttatattcaataaaagtctttattcattaatttaaccaataagtatttattggatataaggtagaccctgtgccaggcacccgggaagaaaatcaaatagaatagtcaatgaagcaaagtctttacaatcttgtgaatatccattacttggccatgattgctcattagaatcaccaaggtggctttaaaaaattagccatgcctgatcattccagaccaactgcatcaggtaattctaatgggaggccaaacctgagaaccactgttctgctttgggaaaatatgatgccagataggttttcttaagaactgtagacttttgatattgcaagctgattcctggtgggctagagttggagctttttagctcaaacactttttttttaaattaactgggccaaaaactaaaaatacacatattccacttagaatgttggatttctggcttctgaggaggaactggatggtctggcaaccttttgtctgcatttctgtatagcagaaattggatgggtctggtgaggagctgcccctttcacacaggacatgcatgctcggtttgccagtttcctctgttgcctatcacacccaacgctaagagacaagtcaagtgctattcatcttggttcacttaactcatttacattagctgcctggcccctgtaggaatttaacttttttactctcctctggttgtttacacatggacattgtaactggtttgaattgtgtctttcaaaaattcatgttcatctagaacttcagaatgtggccttatttggaaaatagaatgtttgcaaatgcaattagttaatataaagttatattggtttagggtgggccctatagccaataactggtatctttctggaaggagaagacagacacacagagagggaagcaggccatgtgaggacagaggcaaagattgaagggaagccagctaagagccaagaaatgccaaggatttcccgtaatgaccaggagccaggagaggaacaagaataggttctccttcagagcctccagaaagagcctaccctgtggagaccttaatgaagacttctggcctcctaaactgtgagagaatatatttatcttgttttatgccatccagtttgtggaaatttgttacagcagctctagaaaagtaatacacacatcagttaacagattttcaaaaacaccagagaaaataaaattaagccatgtccatatattcatcccctactgtatatagaacaatgtctgcacacacagaatcgccaaaatgtaagacaaggggctctacttgtagtgccttctcattagtactggtattttttttttttaattactgccaagctcactcatcccaggcaaattagtccaccacacactaccatggagtggatttctacttgtgtgaaattggcatgttctagattctgtactgctagtattaggtaaatatcagttgaggctgagcattcacaaagaactaaactaaaagtaaatattgtccagtttttgtttcaattaattaattaatcacatgtttattgaataactgatgactttccatatcactaacagccaaattccctaattagcaacctgtggacaacccaccccctccaacccaccgcccctaaatctcatctgtctcctcttctattttcctctaatttctttccttgccactgctggtcactgtgcctgaaatgtctcctctcaaaaatcttcaagatctctcccttacctccttcaggtctttattcccttgccaccaactcagtgaggacttctctcacagggcacttaaaactgtgtcctcacgaaactacttcctattctctttcaattttaccccataggttggctaatgttatagcctaaattgtacctgcccctccctccccccgccacccacattcatagtgaagttccaactcccagtacttcagattatatttggagataatgtttttaaagaggtaattaagttaaaatgaggccattagagtggggccctgatccaatatgattggtgtccttaaaagagaaagatatactgtgatgtctaagcccagaggaaaggccaggtgaggacgctgtgagaggacagccatctgaaagccaaggagagaggcctcagaaggaaagacgcctgctggcagttctgtcaggagatctgatcttggatgtccagcctccagaactgtgaggccagtaatttctgttgcttaagccattcagtctttgacattttcttacggcagcctatgatggtgaactttgtatgtcaacttgacttagctaagggatacccagatacctggtcaaatattctttcttggtgggtctgtgtttccagaagatagtagcattcaaatcagtagactgagcaaagaagacccaccctcaccagtgtgggtggacatcatctagtcctttgaaggcagaataggaaggcataggagggtaagttccctctcttcctcagctggggcttccatcttctcctgcccttgggcatcctggttctcaggcctttggactccagaacttacatcagtgcccctttcagactccaacttgattatgccactgactttcctggttctccagcttgcaggtggcctctcatgggactttttggtcttcgtaatcatgtgagccaattcccataataaatcaacctctttctgtttctctctttgtatacatagtctattagttctgtttctttggagaaccttgggtagacaacatagccctagcaaactaacagagctaaccacatgacttattgtccaacctggaacaccactaacaatgaatgaaggggatattattaataatgatatccagacacttggcataaactgtaacttcccatgtatatcaggacatttggtagccttatccatagtacctatcattataaatgcacaatgcactttagttagttagatgtttattgcctgcctctctccaccagatagtaaattccttgagggcagaggtttttgtgcttttactgctttatatctagcacctaagtatctgggacatagtagagtctcaattgaagaaactgaataaataactgtaaactgtaaggatgtggttaatgttcactgatctatctatatttatgtctatatctatatcgtatctatctatctctatctcatctatctatctatgaaactttctcaatgcgactaccaattattttgtacctgctattggctaagcaaggtactaggcattttacatatgttatcactcattttaacaacaactttgcaagctgcttatggtttctattttaaacttgacccaaatacctcagagattttaggtaacttctcctataccgctcagcatatagctaaagattcaaacttattgcaaaaaagatttttgtacattcttggcagttaaacaataacataaatgcagatttctagcttatcaaatttaatgatcaatacttaggatattgttaactgtacatgttgatgtgccagtgttatctacaaattatatcaatgtgggttcagaataaattgtattttttaaaaaagtgtgggtagaaagatctctaatgctttaatcctaaatcctctatcagcataacagaaaaatcagggacaacaaatcaatgtccctaagatggatatgagtagctcttcctgctaatttgatttttagtaactaattatttaggctggcacacaatgtgaaatattgtccttgaaaacaggccctgctgctcaacattttatttattagaaactgagccaggaaaatctagtgttaaaatttatcatagcagctgaggggttatgtcctgatgaagtaaaataatgccatgacaagatgatagatgttttctgatatcttcttatcactatcttgaccagaccaaaatattgcctaagaggattcttttgagttatgcaaagtgaagtcacattttgtatgcaattttgaaataggaccctataaataatcaagtcttacactatttgcaacttgaaaataatgcaatacacaagtttttgttacatttgtcaagaatttcataacttcaaagctggctggctgaatgaatggtgagctctttaggatattgtgctaaggtaatatcccttaaagcttgcagataaactctggacatccttattagccttatggaaaaatccactaagaccttaaactacttgaggtctccaagaacatattcttcaaatagaacatgatccctgtgtaattcactctgactaggcttcatcctaaacacagtggaactaaatttttaatcctgaaaatgctagcatcactcaattccattctacaaatatctgttgatgcttaggacttattaagtctgccctgatactttccccaaggatctcagggttttattggagacagggtgaacttgttaggcataaaataatcttaaaaatgacctcactctgggggctaatcctgtgcctaagtctgtcattcagaatgtgctactgtattgaatctatcagattctccagctcttccagatctcaatgaaatggaatatagggctccttaggaaacccaagaccacctattttagaaatatgctataactaaacattgaaaaaggtacattataagtgctgtcatatgtaagctttaaaagaatcacttataaaggaagaaatgaaacccggggatgatcagaagtctgaaaactaacggagtgtgtacattaacctggtagattactaaggccaccccataaactatgtttcattcacctttgtgtccccagcatcacgcacaaggcctagcattgactgttcaatacatatctgtttaatgaatgcatcattgttggttgaatttcaaaggagaaagagaggcaggcttctcttcataaataaatcatgactttttcaagattcccaaaacaattagttttccactaaagcaatctgaagtgccagatcctggcaaacctttctgtccctgggagacaagcacgttcagaaaagcagaaccttcaaacttgcagagccagctcatacttggtggccttctcaccttaggctactagttactgagagttggggaaagtggggaaggagcccagcactgtcaacagactttattggttgaagaaaacagtgttgttaaaacactcacagatcataaaaagaaaaaaaaaacacccaaggatataaaattgagaaaagatatctggagaaagcaatattgtgttctcgagctaaaatttcataggaagcttttgaaaatgacctcctgggtaaggaaaattatggatcctatctattctctgattgagcaaacacattgaattcaatacaatctcagcaccacatgtgcacagaacagagcaggacaatttgtctgataaatgcgtttatagcaacaatatttatgagatctatgtaggctttgagacattgagctgaagaagtttgagcttcatgttaacaatgatagcaacacaagccattttgttttctttgtgagtgctttacaaagcactatccaatttaatcatgaaaagaaaacagtcctatgagataagcatgaaaaagtttaggaaacagaaaatgttaaagctcaatcgcgtttagttgaaactcctttcttcagttcttcccatactgggtttctctttttctttatgtccttgttatttaaaatgtaataaggacattggtacttattggtctcatcagcctcacccggtagcttgttagcaatgcagaatcttctaactcactcttgagctactgaatcagaatttgcatttaataagattctcaggtgatttgtatgcacattaaattgtgaaaagcattatctacatggtgtcatattagtcatctggaatgcctgcttttggaatcttaattcattatgaatgagggataagtagagggcactgttataagaatatggtgtcaatctatgaatcttctcaaaacataatcagattcaaatattaatggcattggtgatacataggttaaagttatagactctgaatcctggttttgccacttactgtgtggccttgggaacactccttaactctttaagcttcagttcctcatttataaatgagaataagtatactaaactcaagaggttattgtaaaggtcaaatgaaatgagtacccagagtggtcacacagtgagtttgcagtcatatttattctttaagtatgacatgaaacagagattcactccagctgtctatctttccaagaaaggaaaaaaaaaaacacaaccttttaaagtctttcttttagattttcactaagtcattcctttgaatactatcatagagacctgctttgtgttagctttgatctttggaattctgcggtggtacaaggtcatgatgagcttccagtgaattatcccacaaggaaaccttgacacattttctggacttttcaccacagagattactcatgtcttctcatattctgattctaagaggccaaaattattagataatggggtgacttgaactctaccttttttggatacaagtctggcccttctagggttgatacacttcaaaaattcttcttaaaatctgtggaacaactgaaaagaagctcagataaattctcttttccaggagtcttggagacaaggggacagaggaagagtgatctgtgcagggatgctggaaaccacagggagactacaggaattgaatcctagaaaaaggagctgattacaggagggtcagctgaaaacaaggagccacggcatacccagtttagttctctagcaccatcctggcagcaccataccagccagcaaggtattaggttggtgcaaaagtgattagtattgcaccagcctaatattttatttttgttgttattgctattttttgagatggagtttcactcttgttgcccaggctggagtgcaatggcataatcttggctcactgcaaccaccacctcccgggttcacgtgattctcttgccccagcctcccaagtagctggggttacaggtacctgccaccacaccgggctaatttgtgtatttttagtagagacggggtttcaccatgttggccaggctggtcttgaactcctgacctcagataatccaccctccttggcctcccaaagtgctgggattacaagcgtgaaccactgtgcccggctaagcctaatatcttaaagaaaataactaataaaaaattaaatgactgtgttctctctggtatgtgtagtggcaacgtgaagatccgacttttgttctgagtgaaacaagaaacatggaaaatgctttatgaaaacatattacatagagatgacttatttaatattgtgccattgtttctcatatgggaataatttcctatatatgtggtgtgcaatttaaaattagatatcataaaccactagggtaaaaatatatgaggcctataccgggatgctgtttcagcatgcagaatcattattctttatagagctaacaaattcttaaaagacaggctgagagttaaggatctgaaaacactgcaaactatcaaaggcatacgaggaatttaacaatgcaaaatgaaatttaagtgaagtaccttagttcctcttcttgctttcctactgaacagcaaccctatgtctttctgtagaaatgtttattttgcaccattattttgacacgttcaaatatgacactttggtcatatattactgcatatttaagcatgagacatcaatcagatacatgtaagaaatatgttggtttggtccagaaaggcaggacaactcaaagctggggcagggtagccactataagacttcaaaagaaccttggtctccacaatcttttatctgaacctaaacgtttcctttctattgatctcaggtctttagacaaacccaaccaattgccaatcaaaagatggttaaatttacctatagcctgaagcccccactttgagttgtcttgcctttctgaaccaaacgaatgtacttcttaagtgtatttgattgatgtctaatgcctctctaaaatgtataaaaccaagctgcgccccaatcaccttgggcacatgttctcaggatctcctgagggctgcgtcacgggccatggtcactcatatttggcttagaataaacctcttcaaatattttacagagttttgctcttttcatcggcagaaattaatgagaaactagcaatgcctttaattgcctgagctggttacttgagcagactgtcatccacgcctccctcctctgaagccctacttgctgccccactctattagattatcaattttagatcaactgctgcaggtggtgcctggctctacttgatgggctcccctcagtttgccaaagatttataaaagcagtgttttaaagaatggcgtttacccactgagctaattttcctctcagttagaattccatcattctttagccttaagagtaaaaagtgaaaggagaatggaattaactagagaactgcctatagttctctatgtgactgttgtgttacccttctctaatagaataactctctgctcttatggtcaagttggtgtcatccagagatgagatacaagaatccagggaaattttttatcaatgattgattttatggggcattgatttataatagtaacaataatttaaaactatatatatgtatgtgtgtgtgtgtatatatatatatatatacagatatatagatatatatttgaaaccctaggaaagttatatgggcataaaaatttcattttggaatcatttgtcaattttgccttgaagattcagaagccttctggaattttctgaacacaaataattaaacagtataatttccacactatctctctttttaaaaagatgggtgcttaaatatacagaaaacaactttattattgatttttaaatgtaatacaaaacacctaaccaatgcacagcattgaaacaattcatcaatttatctggcatccttgattggagagtccttaacaaaatgctaatttaattaagccttaactgtttttttctgacaccctgattagaaaatgttcaactaataatataatcttaaataccaataatgttttaaatttttacaaattcgtgcaagaactcttgattcaaatttgatttcctttctgtctaaaccaatctatgaggtaacaattttacttgtgtttatccttggtcatctgaggatgtagcagtaaagaaacagtagtcagaaggtgtttttaggagaaggaggaggaggaagaggatgaggcatgggagtaggaataggataaagactagagtagttttggaaaaaagcatttaagagagacagttttttcagcccagttccaagacattagatgatgttattagaacttaaaaggaaaaacgttctgcttgctgaaatgacattttgcatataggaagtgtgttacgttgctagggctgctctaataaaataccacagaccaggtggcttaaacaacagaaatttatctcacagttctggaggctggacatccaagatgtaggtgtcagcaggtttggttactttcaaggcctctctttttgtcttgtatcgatgagcaccttctcactgacctcacatgcccttttctctgtgctagtgtctccctggtgtctttttctctttttataaggaaaccagccatactgaattagggtttcaccctaatgaccttattttaactttaatgagtaaaatcacaacctcacagattggtttagactgaaagaaaatctaattcgaatcaagagttcccatgcatgaatttcataaaatttaaaatattattggtatttaatattacacaggtagttgaacgttttctttcttttttttttttttttgtttgagatggagtcttgctctgctgcccaggttggagtgcactggtgcaatctcggctcactgcaacctctacctcccagtgtcaagtgattctcctgcctcagcttcccgagtagctggaactacagacatgtgtcacaacgcctggctaagttttgaaattttttttttttaaagtagagatggggtttcactgtattggctgggctggtctcaaactcctgatgtcgtgatccgcccgccttggcctcccaaagagctgggattatagctgtgagccaccatccctggcctagtagttgaatattttctaatcaaggtatagggaaaaaaacagttaaagcttaattaaattcgcattttgttcaccacctctttaaaggcttcatcaccaaatatagtcgcattctgaggtactggggtttagaacttcaacatacaaattttgagggacacaattccaccactaacgggtcaatttccccttcttcttctttcctttccccttccccttccccttctcttcctccctccctccctcccttccctcctttcttcctttcttttctttctctctttttctctctttctcttcctctctttctctttctctctctcttgtcgggcagcctcccaacagggggattttaataaatgtctgctgactcttgatggggcaaatcactatcagctgtgcctattgggctgctttttaacattgctgctgagctgttggctagtgaaacatgttaaggttcttctggtcatccgaagatccatgtgccccctcccttatcagtcccttaccccgtctgcactgaattattacaatagtattataactggttatgcagattcatctatgtctcacccttccatgagagcagtctgtctaaagcctagttctaacgaaaaagcccacagtccttcactaattcaggcaacacgtttctgccatgtctgccttgccaggaactccactagacataagagatacaagagagagcagtcaaaactttcatttgctcccccttgccttccagataaagtccaaattcctttgtataacatttagtatttagaccttacccacctcctcaaatgtccctatcctggaattcacaaagggctatttttcacctcctaaacatattttgcacattagagccaatataccctttatgctctctacttttctatctgttccccttcctatagaaaacctacacatccttccattccagctttagacccttgccattgcatattgtagtgagacttcatggatgtatggaatgaagaaggataatttaaatgtttctgaactgagtatctgggaagaatgaggaaggaaccattcaatagagacagagaaaggtgaaagacaagtaggatttgtaaggtttggggcattgagttaagttttagaaactccatgagaacacattgttctgatgtgtttattgttgaatcttcagcatatagaacagtttctgccacacagtagacacacaatacatatttggcttaatgagagtatatgtgtgtagtccttggtaagaaaatgatgctacctcagtagtcatgacccctttatttcaaaagacacacaaatataacaaaattccagcaccacaaaaaataacttgacccttgaggtttatgataatggaaactgagctttaaatgttaacacaggttagaactgaggaaatttattacggtgttttggaaattaagaggatcctccataggtgtttttggggtcaactaatatatattaatgtaagagttttgtctagaaatttagaagctctaactctgctactgttaattgctagatttgcaactttggttcagttattaaagttatctgtttaaatttctataaaatgtagacagataatctacctatctcatgggattattataaaaaatcaaatgaaataataaatatcaaaacatattcaaaactaaaaatatcattgaggtattacatataaccacactggcaataacagacatagtttttttgagtaaactgctatggacaacttcaggtaggaaataaattgttaaaaagcacattcattgagaacttaggagagattggtagttggataatttcaagatatgactgattatttactttggttttttgatttttgtgctgttgttagaaatgtaaatttttttattttttttctttgagacggagtcttgctctgtcacccaggctggagtgcagtggcgcgatctcggctcactgcaagctccgcctcccgggttcacgccattctccttcctcagtcaccggagtagctgggactacaggcgcccgcatgatatcaaattttcttgaacaactgaactattattaatcgtcaagttttttttagctaattccttatggacatttaatcataacaacctattctgataaaagagattcctgatccagaatactgcacattattgtaatgtccctgtgtaccaacttgaggtattaatctaattaaccaaatttcatgtacctgtcctcctatctctattgcagagcctgtcatcattctttttttttttttttttttgagacagagtctcgctctgtggcccaggctagagtgcaatggcgccatctcggctcactgcaacttccgcctgctgggttcaagcgattctcctgcctcagcctcctgagtagctgcgattacaggtgcacaccgccatgcccagctaatttttgtattttcactagaggcagggcttcaacatgttggtcaggctggtctcgaactcctgacctcgtgatccgcctgcctcagcctcccaaagtgggattacaggcgtgaaccaccgcacccggcctcgtcagtctttttgaaagtctaatagcttaaatactaacgattgccattacacacatcttaaactattaactatgctgaaaattcatttggatttgtttctttatgtcttgaagccatcctgtaatacccacttattgtaaagctggttaaaattcctctaaaatagatggaataaaattcatattgagcaagctttaatatgccattttcaaaagagaacaggtcaggcattattttgcaacagagaccaggttctagtgacatctactcagtgatgtttcccctgatatccctgttactgtgcagagttgaccatagttgtaatagctgttatttgtagaactcgatatagagttgcatggcttgggcacactacttatgctgctaaggctcagtttcctcacagacagagcaaggataataatagtacttgtctcatttagttctttgagaggttaaatgacataattcatgaaaagtgctttatttactcagtgctcattgtttagtaaatagcttgtaaatattacttattgttattattgagcataacaactttaaccacagtaaactgtgacaattggcaaatggaaacaacctcatgtcctccaatagggattggtcaaattcattatggtaactttagatgatagaaggattatgcagccattacataatctgttacagaggaataaatatcgacctctgaatatgctctagatctgctaagctaaaaagtaggctacaaacggtttgcttattgaatagactagaaaatcatatatgaaattgttactggtggttgcctttggaatgcaggagtttttaatttttttgttattttactttcgtgtttttctgctttcttcactgttttccatagagtgttatttcatagagcatattagagtgggtgatgttatatgcaagaaatgtatggcccttgtcactcagtgcaccacgcttcccatcattagatatccagttaatgatgaaaatggctatgcatatctctcttgcccatgaccccagcatcttgagattttataacacacacaactgtcgactgcattgcttatgtaaggccacacagagaacagactatcatcccccaaagcacccagtgaatgcttccattagggagcttggagcccactatgagagaaacagtcatgctcacatgttccccttagtcatttctgctgtttgggacacattactttggacacattaagacctacctatcccaaccttatttttttatgcctgcctgcactataaagattgaaaaaagttaatactcacttccctgtcttctttctattcaggactggtgaggtgatacaatgagacacttaccaatgtctatttcattttttttcatggatgggtgaaggcttatgcttttgtgatgacagtcatgactagtacatccttctctcttacttgtctagagagtaggtgcaattgagccactgcatttatcttacagccttaagggaaaggccaaaagattcccacagctgccagcaccgatatcactgagccgctaaatcaatgtgaacaaaaacttcttatttctagtcttctcattaagtgaggaaaataaatttctataggtttaagcagccactgggcagtttttcgatcactgtaaccccaaaatattcttaatagatacatttttcttaataccactgggatccagacctgatgcgtatctttttcgaatgttttgctataataatgattttcttcattctaaattagcttggatttctcctactggctcacctcactttagagtagtaaatctagcactcaaaagacttattttttttttaaagagggaaggaatttttgtgtgtgattatttgtgtgtctgtatgtgtgtgtgtgtgtgtgtatctgttacttgaaggggaggaagcttttaataataatgtacacctttgtcaacagtacatggccaagtacaattacgccctctcaagcatcattacccaacagatctatcacactgtgcctagttcactttttcctttgtcttctgcctagcctccttcaacaccactccaggatgaggaaagtgaaacatggggctgaacatgacaagaatagtgatcataatctatgtttcaaagaagaaatgaagcagaacgagcctaacggaaatttcagagaaagcttttagttctttttccctttcgtaaattctaacatctccctggtccttttgtccaggagttcagtactttcacggcagcctctgattcactgaaatgtacaatgtcttaccaaggttatccatccccatgttaaactctgttccaacataattatctccaataaaacttccctcttcttagtgtttgtaaagcaatctgatggcattgcactgaagatatagttatgcttggttttgcctagatcctctagccccgttatgcccctttgagtgtgacacagctcctagaggcagtctttggacctggttattaacggaagcttttcctcctcctttaacataagaacttcattttttatccccacatattaaaaaaagggatatcttcacctttaataatctgggaaactcacattgaagatttttacccaaaaagagaaaaaatagactccagtggaatggatatttctaacataagagaaaccataatcagacagattatgagaaaagtgaaacaaatctagtttgttttagctgaattgtctgtttcttacagggctatcctttcttcttactaaacaaggaaataacttgcctgactctgacaattacaaattactcttgtttgtagaaatgaccttattttatatgaccaacattacaatgtagcaagatgaccattatgaatattattcaataagtgcccagtttactgtcgtgtaaactgtgtttgcttacagcatttacttcctccatagtgttcagttttcatggttcattatttaagaaccatgcttacaaattttatataacagaaggaaccctaataaagtgtgagtagaaatagattggctttactgtaccatgtctagtggcttgagatgggttaaattaattttcaaagattatatacaaaggagaaaagggtgggtaaatttctggtaatagtttttgcaactttaatattttctgatcccattattcattttaaaagatgagtgcagtaaggctaaattgcattgttctaccgtcttcctgacatcttgatgacctaggttggcagggattaactgggggtttactccccaggctattccttttcgctgttataaataagtcagtgtagaaatggccttcactcattggattcacactctattttaaacccagaaaatacattctaacattttttattccaagtaatttataaacaagtttacaagtccgtcaaacagatttttgaatgactctattatccctcaggttgcagaaaccagaaaacttggaatcattatagaggaatttttgccttcaaataattgtccatgtggataccacactgaaatttctgaagcaataatctgatcactttttaatccagctcacagtgcatcaatgcttcctcagtacaactatgcttagtgataaggtcctctctaatttcgccccttgtttactttgcaattctcattttttgccatatacttccccaaagtaaggccttcataatcttgcactagtatggttacaagaaggcaaattattttacatttctggggctctgactagaattactcctctgcttatccttcaggttaagttctattaacagatatgtttttaaaactcagatttatccagattaaaaaggaagaagcaaaattatctccatttgcaaatgacatgatcttgtatgtagaaaatcctgagagccacacacacaaaaaattagagataaaaaatgaattcagcaagttttaggatacaagatcaatatgcaaaaataaattcatttctatgtgcttgcaatgaataattcaaaaatgaaacctaaagaaattcatttataggctgggtgcagtggctcacacctgtaacataacaactaggttttttatatataacaactaaagcgtaagtaagcaagcaaccaaacaaacaaataaattgaacatcgaaaaaatttaaaacttctgtgcttcaaaggacactatcaagaaagtgaaaagacaacccacaggatgggagaatatttttgcaaatcatatgtctggtaggaatttagtatccaaaatacatagaaaactgttacatctcaacaataaaaagacaaacaacctaattttaaaaatagaaagaaatttgaataggtttatccaaagaagatatgcaaatgcccaataagcacctgtaaggatgctcaaaatcattagtcattaggaaaattgaaatcaaaatcacaagagaccattttatactcatgggtaaggctataataaaaaaggaggacaattatttgtgtgggtaaagatgtgaagatattagaactctcattactgctggtgagaatggaaaatggtgcggccttttttgaaaacattttggaagttactaaaaatgttaaacatagagttaccatatgaccctgacatttcaatcctaggtatatcctgaagaacagtgaaaatatatgttcccaccaaaacttgtacacaaatgttcacagcagcattattcacagtagccaaaaggtggaaacaaccacaatgtccattaactgataaatgaataaacaaaaggtggtttttttcagccaaaaaaagaatgaatagtgatatgtgctaccacagaggtggatcttaaaaacaatgtaccaaaaaaataaaaaataaaataaaataaaaaagaagtccgactcaaaatgccacacattttagaattccatttatatgaagtgtccaggttaggaaaatccataaagatagaaagctgatgaatgttagccaggaactgagagaaagagggaatagcaagtaactgctaatgggaatggggtttcttttggggtgataaaaatgttctagaattagctagtggtaatgattgcataaccttgtgaatatactaaaaaccactggattgtatattttaaaatagtaaaatttatgttatgtgaattatatctcaatttaaaaataaattcagcttatctattaggttctctaggcaaaacttccttacttctaaggctactcccagcactccttctccaattacactactgcagctcatagttctaggcgatttagtgtagtggttaagcagctggacagaatgaatgtctttcttaaaattcctctgtagctgaccaattgtgagcaaattatttaattgcactgggcctcaacttcctcatctgtaaatgggataataatatacctcactcatagggttgttttgaaaattatctgaatcagtattgcaaagcacttgaaacagtaccaggcatggccaggcgcggtggctcatgcctgtaatcccagcactttgggaggccaaggtgggcggatcacctgaggtcaggagttcaagaccagcctggctaccatggtgaaaccctgtttctactaaaaatacaaaaaattagccaggtgtggtggtgggtgcctgtaatcccagctactggggaggctgaggcaggagaatcgcttgaacccgggaggaggaggttgcagtcagccaagattgcaccattgcactccagcttgggcaataagagcgaaactctgtctcaaaaagaaaaaaaaaagaaaagaaacagtaccaggcattcaataagtacttaataaatgtgctattaccattaaagcaattgttttatctattattatgatcgctataaacattcccctaaaattcatatgttaaaaccctaaccccaaggtgatggtattaggaggtagggactttggtaggtgattaggtcatgaggatggagtcctcataaatgcaatgagtgctctcataaaagagaccccggagagctcccgcatcccttttgcatgtgaaaatgcatcaagaaaatggccctcaccagacaccaaatctaccagttccttaatttgggacttcccagctttcagaactgtgggaaataaatttctgttgtttataagccactcagtttatgatattttattatatagctgcccacactaaaataattataattattatttggtatgtctctccagcattgtaccctactgtctatcactataggcacttagagatgtgttgtttttgaatggctggtcccagggtctaattgaagtcactcgtgcctcttcaggctcagcaactcaactatagtctggtaatgatatctttggccaaacagtatagaaataaacaacatggtgggttcagatcttaccaacgatccgaaccctaattagttgaaaacataccaagaatgttgcaatctgcttcttctaaaatacatttgctccaatgaccacagaaagaaagaaacctgcctttgcactagggtctttggaaattaatagaaagttctgagagacagtagttctgtgaaaaggcttagattttttggatgcctgaaagaatgcttacacaaccttgcagtaagagagtctaagaagaaaaacaagttctatcattgcttgtgttccctatcctgaagttttctctctccaaatgactgttttactcatcagtttataatcttctagcatgacatatatttttcaaagcgccaacaaacgctatttattctctacatgaacatttctcttacgtactccaggaaataaaatattatactcaaatgagttcagcttcttgtcctatatgccagccctggcaactgagctgtaagcaatactttttgaagttcaccctcacatctactcagcaggagtgcaaagcaagatgagaaagtggctcattactttttttgagggaggatgagttccagcaaaaaaattaaaaccacaaaatattttccttgggtgacatatactcagactcagcaaaagtaactaaaagataattttttggatatgtgtagctttacaagcaatctattaaaatattttgattaatacaacatattaattttgttctgcaaaataaagaaaatgcctatagagtcaccaggtttttctataacaataatctactaatgttagcttcaagccactctaggacatactgaattttcttctttcttcaatcaagggtttgatgttgtctaatgtgaaacaaggaagaaaatacatacaccttatatgtatatatataggtatatatacacacataataaataaagcaatagtatttgatctactagtcagtgaagaaatgttttatgattatagatacaatatttggaatatttgacaacatcactctaattttatcttctttacacagaaaaatgataaagagctttccctcagtttaacattgcaagcaatcaatgagattaaatgttgctttaatgccagaaaacaaaaacaaacaaacaaaaaagaccttggggcacattggagttgaaaggtcttttcaaactgcattcttacactctcccatttttcattcttttcccatatggctggaaaaggggaataaattttatgatgccccaaaatgcatatttttgagtttattcctgaagcagacagcttcagagaaaaaaaaatgaattagttcaattttccatgttcctctacctcctacagtccttcaagttactttgtggtcataccacaatcagctctgtccaccttcactcacaatctcctctcttataaaatgacccctaactctctcaggttctctctatgatttctgccccaaagagctctcttctctgacctccacccacatttcctgcccacgtaacctcagagtggctttttagaagtgtttacctctttgcagttgttatggtgcacttgcctcatcctgtaaaattgtggtgatgtggcctatttttctcatgagattttcagtagctttatgcactaatagaaaatatatgtgtggtttctgtgtgcaatctaggagaaaaaatagtaccattatgaagtagaggagtgaaacagtgggaaggggaaatgaattttccacgaacacatgaggttcaagagattttagaagttcattttaattggtagcccttagcatccactcaaaaaatcagaaataataatacttataatcacagcacattctggatggatgtagcttctgttagctaaacagaaatctagtttaaaattgcaaaaatctttttccctcccccgggcagttttgctcacagaaagcttggctgttcagctatcaaagccatttgttttcagtcttaactcttttgcagcaacagttaagccaaacccataatggaggaacatttttctaataacctgtgatatgattagcttctccaaagtcctaaactaaactattttagcttaatcccagttaacttaattgtggtcacactcattttatttttccttacctcccctcctgtcctttccctttcatattttttccttttttggttcttccaccattgaccatcttatgtttatatatatatatatatatatatatatatatatatatatatatatatatatatatatatatatataaaattgagatggggtctcgctctgttgccaggctggagtgcggtggcacaatctcggctcactgcaacctctgactccctggttcaagctattctcctgcctcagcctcccaagtagctgggattacaggcacccaccaccacgcccagctaatttttgtatttttagtagaaaggaagtttccccatgttggtcaggatagtcctgaacttgttatccacctacctcggcctcccaaagtgctgggattacaggcatgaaccacccgccccggccatgatttatattttttgaatgactcttacttcaactcttttcccgacaggggtcacacatgtagttatttaaatttctctgttttatgaaatgtctgtcaagcacctccatgctaaactgcttcaccctaaaatgggatagcgagcaagaccagacgtggtcctgccctcaggaagcttatggcctagcaaaagtgggtacctcattcacattaatcattccataacctcaaatgagacaatgtcctgaacgaaaataaataagatttttgagaaaaaattttttttaaaatgtgccaggactgagacactgaaaaaaagattgaaagcacagtctaagctgacatctcagggctgagtaggttactcttgagaaacaaatctggccaggtgtggtggctcatgcctgtaatcccagcactttgggaggcagaggctgcaatgcctgtatcaggaggcagagataaagtgtgattcttctgtgaaagcctcttctagtcagctagcgaacacatttgagtaaaacccaataacgacaggtatgtggaagagatcgccatgttgcagaccttttgttttaacgtgtccaacttggccttcctcaggattggagctaattttcacatgacacagctctaaccttttgcaggtaagaccttttcatttgatttttcctcctttccaagaaaagttttgagcgttattaaaggccaaagtactgaaactcttctggtggaatttttcttctttgtgaattacttacagtgggacgaatgattcaaaaccaatacattgcagagttggacggaatgtgaaacaagctcatctctgctgtttcctccagacagggctactctgctaaaccgtcaagcagatgaggtgttaatcttacagagctttctctgtaaaatgttctagggcctcacaacctctccactgggaagctgttcaacatcttactcctgttttgcactctaggtccatattcctctttattttaagtatagatgaagaactcttcacatacttgataataattggtttctctgatattaaaagaagtcatgggtactagatacaggagcagatccaagtctagatggtgtggattaatgtcaaaccaggcatatcttttttctcttttaatacttttatgggcttttcattttatttcctctgagaagatgaagagtactccataatcacaggaactctccatggttctccttgctctctcaacacataattaagaaattcctactggattccagatgccgtactaggaactggaattcggcagtgaacaagacaaccatgtttcctatcttcctggagcctgcagcaagagtggtctcaccctgccctcttctcctttcctctcctccctgtgtaatacatcatgggtttagaaatggaggaggtggtctattacccaggaatgcactttacatcaaaatcagggcctgtataactgagtccagactcaatccaaatatccacaagggaagtctagagagttaggaaaaccaaatctgtgagcaaaaatgtcaatggcaagtaggccaactgtaagtaagatataatctgggcacaggtgttgcagactaaagctcccttttgctaaggtgctaacataccaaaggggcctttaggcaaggcatccaggtataaaggcccaatggtaagaataacctattttcttttcttgttttttacataaaatgatacagaaagttagagtgattaggattattagcagggctgatgtgagaggaaaagattataatagttataacagcaacaggtatatcatgttttacaacttgacatgccttattcagtgtgtttcagtgaaaaggggtcaggcagacctgagtttcaatctagtagacattagcccttggagagcagaggctctcatgttctcatttgcattccaggctcctattattgaaccaggagcactgaaaggtattccacgaatgtgtgtggatgatggatgagtccttgctcggctgcctttgggcagtttgttagtagaagagtcctttctctcttcttactctcattttttccacattaaaaaaaaaagatagatcgggcgcggtggctcatgcctgtaatcccagcacttcgggaggccgaggcgggcagatcccaaggtcaggatatcaagaccatcctggctaacatggtgaaaccccatctctactaaaaatacaaaaaattagctgggcgtggtggcgggcacctgtagtcccagcaactcaggaggctgaggcaggagaatggcgtgaacacgggaggcggagcttgccctgagcggagatggcaccactgcactccagcctgggcaacagagtgagactccgtctcaaaaaaaaaaaaaaaaaaaaagataaatatgtatgttttaatattgtttggcgggggggagtcaaatgagaaagcagctggtacatggaaggtgctcaataaatgtatttctttaaagctttattattatctctgaatccatttacttaccatcaaactttagtggaactggcctcagaaacccaatttctggctaacacataaccctacattggtaattagaatcctcttctctttctgggtcttgctttgaagtctgaagaggacctgctcgctacttattttgactatggtaatgtttattgaatggctctaggccatttgaaatgagacaagtataaaaaatttaaattacagtattattacaccattcttaagtaattaaattatttcagaatgtaattttcatatattgaaatttataatatcaaattatatgcaattagacgcaatttctaagagatatgagggagaaatctatttaaattttctattttgccaaagttactcagttttaaaaccattcatttcacgtgattctttaattcttgtaggctaaatgactcactgaacaattcctggacagccctgccgatatggactaggaaaaaattaattgtccttgtatatctgtgctaagattttgaaatgattaaaatttgtataataacattaataatcattgtaaagtacagtacttctcatcttgaaaggctttcatttccatctttatgcaacccagacacattatgaacattctgcaaggagaggataacagcacaggctcacaatcatgaaaaggaatattgtggaaccatatgaaatttaaggtaactggggcaaaagatacacagtggggagaggcagggttgcagactggacttttgtctagtcatgtttttatgagacatgcacagtacatggagaagccaagtgatccctgtggacgatggagagtgagtgagaatgacaatgatccacttgcattttaaaaaagataagcttggggccgggcacggtggctcacgcctgtaatcccagcactttgggaggccgaggcgggtggatcacaaggtcaggagttcgagaccagcctggccaatatgatgaaaccctgtctttactaaaaatacaaagtaagccaggtgtggtggtgcattcctgtaatctcagctactcgggaggctgaggcaggagaattgcttgaacccgggaggtggagtttgcagtgagccaagtcacgccactgcactcaagcctggccacagagtgagacttcatctcaaaaacaaaaataaaataaataaaaaagataagctttgccacaggatagaggaggaatttgagtcaaaaagaactggaaacaggaatactagagaaggggttgtttctacagtccagttaagaggtgatgaagaactaaacaagaaaatgtactggtgatgggaaaaatagtaagacacctgactcaagaggtgttcccgaggcaaaactgacaggattggagatagagaattctaagttgacgccaatgtttaaaagcttgtaatatagggctgatgaggatgcagtgagagcgtggaggatgagatgtaggttactttggccgccatttgcaatttttgaatcaaaagagatccaccatggattattgatgagaactgttaatatgtgtttaaaatttcacagtactttcagatatattttctggttagagccatacaataactctgtaaaataggtagatatgcagataagagaagtcaagtcagttgagtaaggtcacatgggattaattgtcagattatttgtttattatgtcatgttactttttattaaacaaaatcagtgaaataaagctataggtaggaataaagctatttcacatttgaacatttatgaaatatctgctgtggatgcttaatatccattatttaatttaaaaaatagaattgcagaatttaaattatggaaaactgtgattgcaaataaattcaatgctaatgaataatatccttttgtgtgtgtatggttctgcatagaacattttatccttttgaaataaaagcaataatgaataagctttgttgaattgctaaaaacaactattaataagtctatgtgggtgatgttaacaagttgaatattaatgaagactatctctattatatttgtcatgaggccattgtctttacagtatgctagatttatgacatccataactataatagttaaacttaagatgaaaacattttttatctcaattaaaaatatgcaaatacatacataattgctcaaactcatttcagatgatgtgagcaaaaataaatggcaaaagaagcatcagttaaataacagtagacttgaatgcaggagacccatattccaagcccagctttgtgactgttaccagttttaggaccttggttactgtgatggttaactttatatgtcaacttgactggcctaagagatgctcagatggctagtcaaatgttccttctgggtatatctgtgagggtgttaactggaagagattagtatttctatcagtagactgagtaaagaagatcaccctcactaatgtgagtgggcatcatccagtccattgagggcctcaatagaacaaaaaggtagaggaaaggcaaattatttctttctttggagctgtgatatccatcttctcctgctcccagacattgtagcgtctggttcgtgggccttcagactaggagtgattacactactggctatcctggtttgccagcttgcagatggcaaatggtgggacttctagacctcataatagtgtgactgtctgtctgtctgtctgtctgtctgtctgtctatctatctatctatctatctatctatctatctatctcctattggttctatttctctggagaaccctgactaatacagtaaataaatttacttcatgtctctgaacttcagtttctttatctgaaaaattagagcatgaaaataaataaagaaaagttcttagagactataatgtactcaagtataaaatatggaatagccaaccaagaaaactatttggaaatatttcttgcaagatgcctacagcctaagatgtagaattcttcaaatgcattaaatgcttttaaaaatattgtttatagaatttatttttcaagttatgttcttctggtgtacaaaatatcccctccactgtctctaaaaaccttataaaaatacagttttttacagtttatagttaaacatgtgagtacgtgtgtgtgtgtgcgtgtgtgtgagacaacagtgtaaaaaagatggatttttctctttggattatgaacttcctcagtagataatttcaaagggagtgatttgtcaaaagactccagcagtgtcaccaaaatcagaaaatagttctttaaggtcatcatattaaaggccaagaatcatttacatgtagaaatcctgctgagtttgctaaaagtttgtctttgtttcacagtcacaagttgtatttctattcttccattttcttgcaagagaaaacactttaagtcacacctggcactgagctaacaccataagcaggctagctacatgatgatatttgaaacaaatttaaaattcacttaatgaactcaattattgtgtcagcttataaattttcacaccattcctaacattttcttgtcatttttttctgtcttgagaatgaggtatctgcagtggatactgaatcatcaatatcttctgcatggaactgtatctagtttcttcattgtactcacctatatagatgcaacacagaaaaagctcattgatacatagttcataatttgtaatagtgactctaagatagctttagtgtgggacagtctcagaataatattttgaatgaagcaaaagattatatactagagaaccaccaatgtatgagttaggactggtttccacctttccatggactatggtgacttaagcaaacatgcacttatttctacaaaacaataagttcagaagtacgtggtccgatttaagccttcttgtttgtcatgttaaactgtgacttattttctcatgctcaaaaatggctactgtatctttaggggaagaaaagagaatggaaagaagcagtgtctgacccactccactttaacattgcattaaaattttttttttcaaagttcaatggactccagttacactctaatatattcagtatatgtgtggtggcttgtcatgtactcaattacatgtcatatacccaagatcaaagacttactccatattcttcattgtttagctcctatcccatacagagagtaccacatatgatttatttttttctcattttagatttgaagtcattctgactcagggatatattaaaatgactgatacatcctaattaattttgagtatgtgtggcttgaattattgggacattgaatgctaaccacttgataaacagtcttgaagcttttgcacttggagccaaattactttgatctgattgagagcatgaaacagtccatattaggttttattatttctaggccattgcttcagtgtgagaaatccacatatcattctcactaccagaagctccatgtatcagtaatgccaagaatggaaatcctctcaatggtggtaccaagcctaagcacgatctttgtgtcagatgaactttgagatgctcatgatttcttccaaataatagtgtacatgtttatgtagtcagagaatcctccagtttcattcccctttatatatttttaatagagtctatttcaatatattgcaatataaaagttttctcttttctttctttttaacctatatcctacaatctagcacaagcccggaacatagtcaaaaataaatgttgaatgaacgaatgactttgcgccagtttctaagcctctgtaaactataatgtcctcattagtaagcatatatgtcaaaatgcttagcaatctggggtaataaaatgcattaacttggaatcagtttgcgtcccagatccacaatttatcatcttttagaaacttcaaaattaacttttaaattaatacatgcattcattcattaatttaactccatcgactgctctaaacactggaaacacataagtggaaaaaatgttttctagtagctcatagttcagtgtaagagacagagaccagtgcatgataaatgctctatttctttaccttcaggtgggttagtaatgcctgcttcccagatttgtatggactcagtacacaggaatccatgcctactctgccttaaaatatgcaaaaaagcacttttgaaatgttaaaatgatttgctaaattattttaacaacttttttgaaatgtgaaaatggtctgaatcactattttctcataaaacagggctagtaccatgcttgttgcataagagagaggctaattcattatatgcaaaggttacctgtgttgggagtcccacatacccgctcggtgagggtatttggatgaggattcacaagtcatatccatgactattggctatttgaatcagagcaactccatcctaaataggaactgggtaaaaataaggctgaaacctactgggcttcattcccagatggttagggcatttgaagtcactagataagacaggaggtcagcacaagatacaggtcgtaaagaacttgctcatcaaacaggttgcagtaaagaagccagctaaaacctaccaaaaccaagatggcgatgagaatgaccaaatgccatgacgacatcaggaagttgccctatgttctaaaaacaagaagcatgaataatccacctcttgtttagcatataatcaagaaataaccataaaaatgggaaaccggcagccctcaggggctgctctgtctatagagtagcgattcttttatttctctactttcctagtgaacttgctttcacattactctatggacttgccctgaattctttcttgggcaacatccaagaaccctctcttggggtctggattgggacccctttcccgtagcactaggacttattacatgcctatgatttattacatggttacaatttattattacgtggcaggaggacacaaaacaaaatcagcaaaggaaaaaggcacatggggcgaagttcagaggaaacagttaagcacagacttccaataactctttccgagtggagtcacataggactcacttaattctaccagcaacaaattgttacaacaccttgaaatgttgttcctgataaaagctcattagagacaaagtgcccaaagttgtttttggggcctggtcacataggtgctctctgcccaagatttgagactccgagaaggaaatcaggtgttcagtatcaattatattttttatacaaacatattttttatacacagcaaattacccttatcagacagcaaataaagtgaatcctcctgaaatccaggttcccaaatgccagacaatggtcaaccttgcaagcagtcctatctgtttagctgtttcaggcctgctctgttaaggctcttctacacaacgcctaagggcatttgattgaaaaagacacctggcctcttggggtctttgcaatgcttgctaaaggaaagtttgacaggtgagaggtgcaggaatagaatgcaactttttatcccctccccttctctgggcaaaaacaggtgaaagattggacaatagattaactatgtcatctgcttgcccacctttctgattttgctgcttatcacagtattcatcagagatagaacagaggtgattttaaaactctagtacattgcaagacaccttcagctgcattcatgaagagtgctgtttatattgtgtttctgtgctttgcatgtactagagcttacaatttaaaatcaaccactgcagaactctttggtaaagtgagaaatccatttataaggttcatttcttaagtcattcatcctgtaagttcagaattgaatgttttgagattctttaaggcacacttgtggggcactggagctttttacagctgagtttccacatgagtcactccaacatactgaactgcctggacattactgaatttagaaaagcttctcttggatttcttgttactatatggtatttgtgctttcaacttagtttctcttgctcaaatatttagtttttgaacactggatataattgcacagccaaaaataaatttttacacctctctaaacaaagcaagaaactgtaaaatccacaattagtatcatgaaatcttattgtaattttctttctttctttctgttctttttttgagatggagtctcgagtctcgctctatcgcccaggctggagtgcaggtgtgatctcggctcactgcaacctccgcctcctgggttcaagtgattcttcctacttagcctccggagtagctgaaactacaggtccatgtcaccacacctggctaatttttgtatttttagtagagacagggttttaccatattggccaggctggtcttgaactcttgaactcgtgatctgcccaccttggcctcccaaagtcctgggattacaggcatgagccaccgtgccctgcccttattgtagttttctgaagatattcttgctggtgttattttaggaatgtggctaaatggcctttatctgagaaagtgagttattattttagggagtggcaaaagaaaaagaagtgtgtgggaataaaatgtttaaattgctgttttcttagcagctataatagtgcatgcagctgccaggactacaatatttagaaaattcaaggatatttatctctaccttaaaatattttgaagactatactcgcttacatttgcagttctttgaaatgtgataatggttgatcaaaagtaaaaagatattttcttgattcaacattaatcctttcctggagtaactttacccccaaaaaattaaaataaaaggcaaaaaatatttttttcttgctagaattttaaattctggagtaagatttgagactgaattctaactgttttcagtatgtggtacagtttaaattaaaatatgtgtcgggtttagtcataatgtccttataccatttatgttgtattcaactgaatagtaacactgtcatcataaatgctacatttatctagattttttaagtgtatttttagagccagacaacaatgcaacagcatctatcccactatttttgtctaagcactgctatattaaaaagcttattgtttctagggcttgttaatcttgaagacatgatttatttctatgggactaatttattcaattcgagcagggatgatagaaaatactagaataaaagcaaattactttatggatatgtgcctgtgtgtgtaattggacacaaagaacaattagaggcataaaaatgttcaaataaatgcattttttcagagtatgaaaaatatatggcatttttaatgtcacctataaaactacgtataatctataaattatattatccttattgggactattcattgatcatctaaacagaccaatacaaattttctaagatagtttctttttttttttgtattttattcttcctattctaccttgatttaccaagatatgaaactacaaatcaataacatggggaacttggaaaatccacaaatacatgaaaattaaaccacatgctcctgaatgaccaataaattaaagaaaaactcaaaagggaagttaaaaaatattttgaaacaaatgacaacacaacatatcaaaatctatgggatgcagcaaaaacagttctaggataaaggtttataacaataaatgcctacattaaaaaagaaggtagattccaaacaaatagcctaacattatgcctcaagaaactaaaaaaaagaagagcaaactaaacccaaagttagtggaaaaaagaaaataataaagactagaatgaaataaaagggagcagaaaaaccatttaaaaatagtaaaaccaagaattagttgtatggataggtaaacaaaattcacaaactcctaactacctaaggaaaaagactcaaataaataaaatcagaaataaaagtagaaatattgcaatggaaacttcagaagtaaaaatgattataacgggctattataaacaattatgtgcaatatttaatcaggaagaaatagaaagcttgaatggaccaataaaaattaagagattgaaatatgaattcaaaactttgcaacaaagaaaagcccaggacgagatggcttcatgaatgaattctactaaacattcaaagaagtattaccaatatttaaattctcccaacaaatagagatagaagaaatacctgcaaacacattttacaaggcaagcatcaccttgatccctaagccaatgacatcacaaaaaagaaaactataggccaatatctctgatgaacattgatggaaaaattctcaataaaatattagcaaacaaaattcaacatcacatcaaaaagattatacatcatgaccaataggatttatccctagcatgcaaggctggtttaacatacacgaatgaaacaatgtgacacatcacattaacaggatgaaagataaaaaacacagaattttctcaatcaacacagaaaaagcatttgacaaagttcagcatcctttcctgataaaaactcttaacagtttatgtatagaaagaaaatttctcaacataatataataaaggtgatttatgaaaaatccacagctaacataataatcagtgggaaacagttgaaagctttttcactaagatccagtgcaaagcacaaatgcccacttttgctacttctattccacataatattggaagtactagcaatagcaatcagaccagagaaagaaataaaaagcatttaagtcagaaagaagaaaaagtaaaattatctctatttgcagatgatataatcccttatgtagaaaaccctaaagattccacaaaaaactgacagaatgaattaattcagtaaacttgcaggatacaaaatcaacatacaaaaatcagtagcatttttatacactaataacaacatatctgaaaaagacgctttaaaatcccatttatgaaagcataaaaatagttagaaataaatttaaccataaaggtgaaatatttgtataccgataactataaacctttgataaaaaaagttgaagaagacacatataaatagaataatattctgtgttcatgaatcaaaaaatttaacaatgttaaaatgtctgtattaaccaaagcaatatacaaattcaatgcaatttctatcaaaatttcaaggatatgcatcacagaaatagaaaaaaaattcttgaaattcatatggaaccacagacacataaaaacagaataggcaaaggaacaatgagaaagcaaaacaaagcttgaggcatcacacttcctaagttaaaattatattgcaaagctacagtaatcaaaaacagtatacaaatggcatgaaaacgaaaatgtggaccaacggaacagaatatagagagccagaaacttaactaattttcaacaagggtaccaacaggacaccctgaagtaaagatagtttcttcaataaatgattctgggaaaattggattgcaacatgcagaagaatgaaattggaccctaatcttgcaccatatacaaaaatggactcaaaatagataggagacctaaatgtaagatgtgaaaccataaaactcctagagaagaacatagggggaaaaattccttgatattggccttggagatgatttttggatatcacaccaaaagcttaggctacagaatcgaaaataaataaatggaactacatcaaactacaaagtgtctgcacagtaaaggaatcaatcaaccaaataaaaaggcaacatacagactgggaaatatattttcacacagcatatctcctaagaggctaatattcaacatttgtaaagaacacttacaaatgagtaacagaaacaacaaacagcttgattaaaaacaggcaagggacctgaacatacttttctccaaaggagaaataatggctaacaggatatgaaaaggtatacaacattgctaatcattagggaaacacaaatgaaaaccactatgagatatcacccttcacccattaggatggctattataaaaaaaaaaaaagacaagaggttactgctggtgagagtgtggggaaaagggaaatacagtacactgttggcgggaatttagatttgtgtagtcattatggaaaacagtgtggaggttcctaaagaaattaaaaaatagaccagcaatgacccaacaataccttttttggggattgacccagcaattcctcttttgagtaggtaaccaaagatgataaaaatcatcaccttgtaaagatatctgcactcccatgctcattgcatctattcacaatagtcaacatatggaaacaacctaagagtcaggttgacagatgaatgtataaagacaatgtggtacacacacacacacacacacagacacacacacacacaaacatacactgaatattcttcagccataaaaaaaggtgatcctgccatttgccatgacatggaggcatgggtatacctgaaaaatattatgctaaatgaaataagccagatagtaagaaaaatagagtcatgtatcatttaacaacaaggatatgttccgaaaaacgcaacatcatttgctgattttgtcatcatgtgaacaacacagagtggacttacacaagccgaaatggtatatactactacacaactagtctatgtggtatagcctattgctcccaggacacaaacctgaacagtgtattactgtactgtactgaatactgcacacaattgtaacacaatgggaagtatttgtgcatgtaaacttatctaaaaatagaaaatgtatggtaaaaatgtggtattataatcttatgggactaccatcatatatgtagtttatcattgattgaaacatcattatggggctcatgactgtactacatgatttcacttaatgtagaatcttaaaaaagaaggtcaaatatgcagagatagacaataagtggttcccagggatggtgggtgggggaaaaaatgagatgaaggtcaaagtatatgaagtagcagatatataggatgaacaggtctagaggtctaatgtacaacagaagatgataatagtctataagagtctaatattgtagactataatagtctataacagtctaatattgtagactataatagtctataacagtctaatattgtagactataatagtctataacagtctaatattgtagactataatagtctataacagtctaatattgtagacaataatagtctataacagtctaatattgtagactataatagtctataacagtctaatattgtagactataatagtctataacagtctaatattgtagactataatagtctataacagtctaatattgtagactataatagtctataagagtctaatattgtagactataatagtctataagagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataatagtctaatattgtagactataatagtcttctgtattaggttaaggctttttgttaaataagtagattttaactgccttttccccaacccccacccaaagataactatgcgagatgatagatacgttaatttgattcaccatagtaaccattttactatctgtagtttttccataacttgtaaacctcagatatacacaaggaaatttatttttaaaaagtgtacttgtcaaaatatgcttaaatacagattcaactttcagtttttaaagattttaacataaataatttttaactattttgctataatatacattaatataaagaaacaaatgagaaaaaaattgtcaggccattatatagttcacttatatgacaaaatgaagggtttcctttcaaaattatgtgtttgcatcactggaatttagagaaatcctcatagcttaagtattggaactattgtttataaaaatgcagagtagaagaccaggcacagtggctcacacctgcaatcccagcactttgggaggctgaggtaggtggatcacctgaggtcaggagttcaagaccagcctggccaacatagagaaacctgtctccactaaaaatatgaaaattagcaaggcatgatggcaggtgactgtaatcctagctacttcgaggctgagacaggaaaatcacctaaacctggaaggcagaggttgcagtgagctgagatcatgccattgcactccagcctgggtgacagaatgagactctgtctcaaaagaaaaaaaatataaaaaaataaaaatacagagtataaacaagctaattgtaccagtgtttatgaaatgtctagtaaacatataagttgttaaataaaatttcctattttagtcatggatgcatacaagtaaatagatatttataacataatctgataagtaaatgttctaagttaatgagaatactgtggaaatccatagagtagcacctaaatctaccaatagaaggtgttaaatttatgaaggctttccaaaggggtaatacagaagttggactatcattacatggtttcacatatatcacactttaatttgtgattatccacaatttcttatattttaaaacaatttcaaagtaaaatctggcatactcagcattagtaaatgttcaaaatattagtccaaacaattgttactttaagctaaaattatatggatttgactcttcatttccttcttttgccataactttagataccacgtctagctgaaaaagaaaaaaaaaaaaagaaagaaatttagccagtactgaattgaaattacttcataatgttcacaagtagggtggctacccgttctggtttattcagggtctcttggcattttatcaaacttccatgtactggaaaaaccctaagttccagcaaaatggatggttggccattctacccattggctcttctcaatcaatgtgatatatttccacacttctatttgcatgtgtgcattgaagtgaaaaaaggttttggtaaagttatgtcacctcaaggatcagaagcaggtactttattcaagtaagtatgaaagcatgcacaaaaaagatatttcctatataaatagcaaaaattatagaaggcaaatctaggagtgatgctataattgatgtgaacttttaaagtgaaactgaagttcataaaataattttacttggatttcttgtcctccaacttcctcctgtccatgtttttctgcctcataaacacacgtacccacatattcagtcagctcctcctatattttatcaaaacaaaacaatatgttctttaacccaatgtcatgtagcatggtggccacctcacctatgaatttctctcttaaagtttaataagacattctatatctattatcaatttactagatcattccacatcatgtgccactggagactattcttccttgaatttctcccctctcttgatttattgacacaataccctcccagttttcctctttcaaatccttggcaactttttgcctatctgtttttgggcttcccttatttcactcacccttaaatttaaatatttatattcctgagagttttgtcattgatttgcttctctctttaatccacacactatgcaagcattgcagatacaacagtggatttttctaaaaagataaaaatttctatcatcatggagcttaagttctagtgaggagaaataaacaaaaaataagtaaaaaatataaacagtttatcatatggctctaagtgctatgtagaaaaataaagcaaggaaggaggctgtattatactcatagagctgccttgacaaatgaccattctcttggctatttaaaacaactgcaatttattctctcacagccctggaggctggaagtctgaaatcaaggtgtcagcagggacgtacttcctttaaaagctctaagggaaaattattctttgcctcttcatcttctagtgactccaggcatttcctgactttaagcaacatcactccagtctctgcctccatcttcacatggccttcattcctgtgtatgtccacctttccatgtctccatgtctccaaatgtcccttgaggacacagtcattggatttaaaacccaaccaaatccaatatgacttcatcttaacttgattgcacctaaagagactctatttccaaaaaaggtcatactcatagggtctggatgaacatacatttttgagatacactattccactaactagagagactgaaaaatgcttgttgcagtgattgatggggaagatgaggaagtcagtggggtatctctaaccaaatagctcataggcatttcaaactcaacatgtccaaaattgatgtcatcatgacagtctcttaaaaccagcttccaagcgcttgccaaatgctgttccttggctagaaacatggggataatcttagatactcaaactgtctccatttcccaacaaactcgaaaccctgtcaatcctacctcttagaaatgtatcaagatatctccatacctaattctactacctctctctaggccattcttatttctgtccaagttttccaccccaattctctacactgccttaaaggaaacttctaacaagaataatagtatcatgtcacctctttgtaaaatatcctataataactctccaatatttgatataaaatatggtttcccttacaagtaaacagaaattccacccagtttttcttagcagatgcaactaaagaagctctaatgactcaaaagtctttttctgtggcttccataaacatttttcatcctgtaccaaccaataatctcagttcttctcctactacatctatccaaacttcctcaaaccagctatactcaaccagcttctactttctagccagtttcagctgccatcatcatcactccctcctcttcatgagcatcaacaatgtatctgatagtgtttaggcactttgtgaatgtaatttttaattcacttaacaatcctaatgatagaggtcttgtgattcccaggttatacatgaaaaaactggaacacaagagcttaagtttctttcctgcaggattcttaatcatatgaaagatacagttttttttttaacttacaaattggagttaacagtatctactctattgaactgttattcaaaggattaatttaacaaggatcactacactttataatcttttcatagaagacaaagtggtggtgaaagcaaaggggctgtctgtcataaagttggtcctgagcctataacaggattaaagaactgcagtttccatcctggcagaccttcagcccttagactcagtggggactacctaacacaaccatagtatagaaaacgggttcatttattcatttagcaaacatttattccggatctttcatgtaccaggtactaagattaaaagatatgttttttttttctaaaataaggccccgtcctaaagatttcatcatgcatacaggtacattgctatattactctatttataaagcaataataactttactccttctacaagtactgaatatttactctgagtccagtaccctagtaggtattaaaaaaaattccaaaattctaatctaccagggagaggtttacaatgtccatactcagactgtacaatactctccatatcctatgagtcttcactcatcccttcattctcctgtattatttgcatatgtctgtatcctgagctcatccacaagcaacaggatggaaaaaagcgtgcttcttgtttatttttcaatccctcaccatgtcccacagagcacaaagtaaaatagaataaaatttagccaaaggctggtacctgaaaaatggctagcaataaaaccacagttattaaagacagagtgcaggttgcaaaatgaataatagttactctgcgcatctgccctgtggctactctgggccctcagaactgtctagggcatgatctcaagcaggtagatcagtgtgctgatctgttggctgaaggaaaaaagcgtaacgttcttggtgtccgttctactctccagtacaggtttggcattatgaaaggaaagaagaggggtagaagcctccttaggaaaaagagctggcttttggtgctgaaacacctgcctagagtgtttgaccactgctgtgacttgtagcaaaggtctttatttagtgctgcataatctcataaacacatacttagggcatgagcaaaaggtgcccccaaggagtcttttttttttttttttttttttttttttttgagacagagttttgctctgttgcccaggctggagtacagttgcacgatcttggctcactgcaagctccacctcccaggttcatgccattctcctgcctcagcctcccaaatagctgggactataggcgcccgtcaccatgcccggctagttttttgtatttttagtagagacggggtttcaccatgttagccaggatggtctcgatctcctgacctagtgatccacccgcctcggcctcctaaagggctgggattacaggcgtgagccaccgtgcctggcccccaaggagtcttttgaaagcttttgatatttgatactggaagaaaaaatgtgatcataggaaaatcagaaggtcatatgaaatttttgtctttatcattaaaactgtttctcatcacataagaagaaagcaccaaaacctcttcaagttttaagacttgaaaaagttttcacatggcccaactttaagtaaaaattagagtctgctttggatgaagctacctcttccacactcggtcagactcttccttatttacagcccagctataagtctgtccagggcatttcagaaataagtaattaggccataattatttatgcaaatttataaagcctagtcataggtttaactttctttcttcaattctcatgtttaactataatggttattttacagagaaataattctattttttcccttgaaagtactatacaatgactttagagattctagaataggtgactctatcttgtttagtcattatcaattttaaattacaaccaaagaaacagccaagcaaacatgaacagggtttctcataaatatacatctttaagtttcaaagagacagagctaatgaaactgtcactttgaatgctaaatggagctcttgatgtgcttacgttgaatcttctctagattttctcatacacgaaattttgctagtttttttttttttttcagcatcagttcaccactcaattaaaggttggtgcagaatcaggagaagccaaggcaaagaggagcccagaaaagctcttgtaaacacaagagcttttggtattggctgactcagagaccagctatatttcatgaagacaaaaccagtccagccagggtcctatgactgtgcttgtcacctcttaataacctgggtcaccactgatccattttaccagtctccatcactgctctgtgttgatgactagcatccttgatcagctgaagcatcaaaatgatcgggctttaagtcagaatatttaagagcaggtatttccagtcatgtctcttacgtgtactgttgttggtcattgagcataaaactggtccttcccactctttgattacataactgcctctaaactgcctagactgagcccctcacagcttcacaaacttctccaatgcctccctatcaaaccctttccattgacatttctgaggcctacattttatcataaaaatgaaaacaaagaaacaacacctcttacatattctccaattgtatagaacaatctttctattgcttatttttactgacacatggcttagtccagtcccaaataaaagacacacatgcctctgaagactcctgtcctgagagctatacttcaacctctttatcctgaacttcacatagaaatttttgaaatattattttatgcttacttctatttctcatttctcattcactatgcagccaactaaaaatgattttaccctttatcactctagcaaacagtctttgatacacatatctatgatcacctaattttcaaattcagtgactcatttttcacatttttttttattggactgttctgttgcattagacactgtggaaattctgaaatctctaagctttcctgatgttgctctaaatctctcaccattccttcctacccttcctcacctttaaatgtagatttgattcattatatcatccttgatctcactccataggtttcctggagctattgcttcccaactctacattcctatttgctatctccttgctgaaacttgctcatctcagcttgcttggctgattcttccagatttccgatgcttccctcattgctagatgttaaactttcagcccataatctttttattaatttattatttatttatttattttttgagatggagtctctatcgccaggctggagtgcagtggtgcaatcccagctcactgcaacctctgcctcccaggttcaagcgattctcctgcctcagtctcctgagtatctgggattacaggcatataccaccatacccagctaatttttgtatttttagtagagacagggtttcatcatgtaggccaggatggtctcgatttcttggcctcatgatccgcccgcctcagcctcctaaagtgctgggattacaggtatgagccaccacgcctggcctcagcccatgatcttttacactaaacagcacatacatctgtgcttcttatctgaattgactataccactttcttacccagtcacccacactggaagcatcttggaccatccgcaaccaggctttcaacaaatcaccaaatactgcaaattttagctttaaaatatgtatagaatctgatgttttccacttcatccaaagaccagtatcctggtccaagcttttagcaatgtctgaactcctgaaatagcacctaacttagttctcaaccttgagccttattcttctcatatgtaaactcctaagcaatgctctacgaagatacaaaaatgactacgtcattccactcctagacttatttcttacaactgcctgacttgtactttatgtagatctctcaatccatcaaccatttcgcaatgatgtgcctctggttttgtggtggtcttctccacctaggatgcctttctgttacttctacttgcaatcagctcttcttcatctgtccattaaggcacagcccagtcaacatttcttctaggaaggctccctgaccttcccttcttgcattagatgcaatttctcagtcgttctaaaatgagtaattattatagctgtcacttaactattttgtatttatttgatcttatgtctgtctcctcaacagcctttgagttcttcgaggaagatggctgtatctcatttatctaagtagtgtcagcatatgcaagttgctggacacaaaatagtcaataaaactcttaaattgacaacttaggaagtgatccaattttaattttctttcgttcatgaaaagtagggataaactgtgtttttcatgttcagagattgatgaaattcatgggatatttctgaagatctttaaacattcagcatataaaaattatgaaatacatttcttgtgtagtaatttcctataagggatattctgactgttggctctttcttcagaaactaaaatttcttagaaaataacttatttggattatcatctaattcagactttctttcaagcagaaattttatccaggctacaactattgatccagataattattcttatcattacttcttgtatcagtctttgaactacctttgtccatgttgttctgcttctagcaaagactaattaattagtagaggagaacatgaacatcagctgaaccgctgctgtaagaaggtagagaaagactgtggagaaaatatgggctcagagatagacacactggattccagtctcaaccatttaatgcctgagtgacaatgagcacatttctcagccactcttggcccatttcatgtttttcaaaatgtgaataacagtgttactcggtataattattttgagacgacatgagttaatgcttttaaaatacctggcacaataatttgaattcccctttccccatgagagttgacatgcacctactggataggaaagcctaaaagaactaaacacatgtttcagtatttaactatttgcatgctctctaatttctattcacatgtataatgacaacaggtcttctcaaaagatgatttctcagtaaaataaaattaaggcaagaatgacatgaaataatttttccaacgttagtagtgaacttatttctgctttacttgactggttgccaaagtttttccttgactatatgaaagaaattgggtaaacttttcttaattggcaaaacaaatccactccgaagtaaaagttacgaaacagatgttttctgcttcttaatagaaaagctagtacagaaaggaagttccaaatggaacattctggtggtgccaaaggaacggagaaagaaggacaaaagaagaacttttaaaggtagaaattctcattatgatgattgattatttaaacaaggttaatttttcgaggcttatgaacctggtaaatttaagacggcaaacaacaaaatgctactgctaattagacatccaatgaaatgccatacagaaaggttaactattttaaaaaatgttatgtaatcttctatttcaaatgtcattgttattagttttgtaatagagctcactgacaaaacagacatgaatatatcttccagagagtgaggaggaaatattttattagttgtccagtatatagagaaatgagaaaaatattacaataaattttcatccttcatttgaaatattcacatttaatcatttctgtaggaccggagttattttgctttgggcagacctgaccctaggcagatttgaaaacaacaccacaatatatgcattgagggcctactatgtgctaagcactgaggaaataacagtgaacaaaacaggttaaggtttctggccccacggagggattctagtaggggaggacttgaaatagggaaattgtagtgtaatgtgatgtccagtagtaacaaacactaggaagaaagaccgtttagagattgttattttcctgaccacccagcatagcaataatggaaacgtttggctggggttccctcaatgcattccctggccactgctgcaatgagtgagagattaagtgagtgtgaggagaagaattacatggtgagcactggataatttccccatcttaaccaacctgtaaggcagcctgaaccatctccatcctccagataaaacagctaggatttaggaaactgaaggaactcagcccaggtctctcagctagtaaactgttaatgcagtttctctgacccaaagtctgtgcaaatagaacatctccaaggatgcagaggcagtgaatcacagaagtagctgcattgcttctcctttaaggtgtgaataataagcaccaggtggtttgtgcgtattatcttctttggtccccaccacacaactatgacgtagggccattattatccacagtgctcagataaggaaactgacactgagggagggttaaataatttgttcaaagtgatggtaggtctataatacaaactaatctctgctatttccttcttttatttttatttttatttttatttttgagacagagttttgctcttgttgcccaggctggagtccaatggcacgatcttggctcactgcaacctccgcctcccgggttcaagcaattctcctgcctcagcctcctgagtagctgggattacaggcgcacaccaccatgcccagctaatttttgtatttttagtagagacggggtttcaccatgttggccaggctggtctcaaactcctgacctcaggtgatccacctgcctcggcctctcaaagtgctgggattacaggtgtgagccaccgtgcccagcctctgctatttcattctaaggagcttatgtacttttccttgaggttgttgacttcaaccatgaatcaagatcaatatgtttgattaagaatgcattgatcaaaataaggaaatcccagagtacagctgcagaatgtataaatgcaggcattgcatttttttattcaacctataattatttatgttgacatttattactacatatctttaaaaatataaccaactgaatttggtgaggaattcagtgatgctataatggtctctgttcttctgaagatgtgtggctgccaggatagtggtttgtggagcatcagctacaaatgctcttagaaagcagcagtgtgcatgccaaccagtttatagcctataagactgtattctcttcttatgaaggttgagcatctattaatagctgaagctaccatttgtggcagaggcaatattttaatgcttaagagctgggtttcaaatccttgctctgcaatttactacaaattacttgctgcccactgaagctttttgttaaatgctcattatattgctgaatgcttattatgggccagggactattctgtgcactttaaatttaatcctcctaataatcccaggatggatggctaaccccattttatggaggaggaaactgagctcagagaggaaaaatgaatcatgaatggctgtacaattaataaactgccaagctggttttgaaccccaggtgtctctaatagtttcctccactacatgacactgcaggaccaatgagaaacagtattgagactatataagaaacagagtcagctttgtaatcagggctaagcatttagatcccatactagctcaacaaggcactgtttctccagttctgtcaaattattgacaattttgatttgtagtccaatctagaataaaatgtgcaagggacatattattgagagcacaaggaagactatgaatgtcagagagaagaatggaaaggttgattctgagagtctaaaatagggaatgggttagctaggttaatcaaggtaatcacaggaggccttgaccagttgctctacctaaaactcagtttccttcagcttctgtaaagtagaaataatcatacctagttcattgggtgattatgatcaaaagtgtgaaaataagaccagcccctagctccattcctgtgcatgcacacattgaccatagatagccctcaactcaaccccacgttgatcatgctccatttttctcagctgcagtgcccctgaaagggaatctctggccaccatgagtgatctggaggagcagtttcatgtctatgctgagggtgatttccatccatgacatggtcatgagaaggacaacagagacaccttgaaagggactggagttgcatttccatagaccaaagactaatgagccactatccctttcactcaaggtgactactgagcaatcagctatgattacacacccctccatgactgaggattctgatcctaacaaggcataatggaaaattcacttgtgcttcacttcacacatgatgaaaaactaaaatacaatgattggttttctctttgtcagccagatgggttcttcctaaatgcaaatccacagaggctgccccactgtgatgaggctctgcactcatcatggcagagacaaagaaggtttgcgggtttgcctggcagcttgcccgaggctttgcatcggctttgggaaaaccagaggcctatctaagcctcaggctatccatctgctgccaggtagccctccctctgccttcatcctaaataaatctgttttggaggagccaggaagctttggggacaagatctattcactaactcatatgtaaaaatgccacctacatctggcaaattcaaatttctgttttctgagcacgtgtttatacttatttattgcctctcttaggtacagttagatctccatgaaccagttcaatcagacttaataacttccccaatgatcctagccaaaataagaatgtacctgggaagagaatcttagcctcagaactgcagttcagaagagcagctcttcttgaattctaccacatgcctttgaatctcaggagatctgggccatcaaaagtccatttggttccaatgtctcactctccagagtgtggttgatgaaccagcagcttggacatcctttgggagctgtgactaattcttaaaaatgcagaatagcaggtcctacccagacctactgattcagggcagcaatctaacaagaatccaggtgacttgtgaacacactgaagtttgcaaagtactggtttggaggtcattcaaccatcttattttccagagagggacactgccaagtgactttccagaacatcccacagcagggtccatttagaattccaggactcgaattcagttgtgttggcaagaacatttagccctatcttgaaatcttctgggcctttgtttccgtaacactaaaatggggacattcacaactgccttgcttccttgttggtatacaatgtcataatatatatgaaagcattttatttcaaagccttatgcaaacaaatatgtctactgttatatccaaccaaactcacttgaatcttaaaagatgtgtacgtgtgtgagtgtgtgtgtgagcaggagttctaggtatagaactgggccatatatgacaaattttgccctactttagaatgtaacctaattctcagactgcttgccaaaaaaaaagaatcctttctcctctaactctcaaaacggttcttaaaatagatgggccccccagggactccccgacatgtttccactgttagagttcaggcagcctgagatcaacgggttttatttcagatgatgttcgatttggggacatgagctcaggaggacacgtaacaggttagaggtgagcagccctttgtatttttaactttaaatcatggcagtcgctcaaatcaactatagtttagtagacaaagggaatgagaaagataaatataaggactgagagaagagaaagaggataaacgtaaggagaaggctgctgttgatagtatccactcattaaaaaaatactgagaagtttatatatgtcagacactgctctaagtattttggacacggtcatgaacaagaccagcaagggtcctcactgtgtatggcttatgttctggtggtggtgggtaggaggacaaattgaaaagcaaacatatgtccaggaaaacttggggtaggaaaacatgctttgagaaacctagctactgcacaggttctgcctatggttggatagccagagtgactactctgagatggaaattcaaatgaaaccttaaggagaagaagccatgtgtagataagggggaagagcttcccaggcaatgtgaatgctccgaggtgagaatgagctggggagtttcgagaaacagagagaaggcctgagtggtcagatggtggtgagcaaatgcagaagacgagttagcaaggttgagctaggttggatcatgcagggcctgtgtgtacacttaggaatgcggacacctgtctgagtgcagtggaacgtcattgctagctcaactagtgatccactgagatgtagaaattggaatcttggaatctcagcacgcagcacaggttaatagactgaaagcaggaaaatggaagtgtattttctcattcttctttctgtccttgatcttttcctcccttcaggtttttatcaaattcttattatgtgtcaggcaccgtgtcttagtgagcaatggactaaccttcttatgaagttaaaatacattcattggtgtgagttagtacaggatacctattccaatctaataaaatgcaggcccctaatgaaatggggtcctaatctgtgggcccccattgccaacagcagtggctcttaattgcagattgttacagtgaagaccttgttgcatgcaaaaatactaggattccattcagatgtattgaataagaatctttgaggatgagcctgcctatatgtatttttagtatactgcataagtgatgctgccagctgtgaacgtcctcttcttgagcctctctctggcatacctggcataccttctttgctcccctaagctccccttagtcttgagggatcagtgcaaagtctgtttcctctgttatcatcactctaacttacgtgactttgcctgatattcctagtttttgatgttttttagttttagttttagttttgagatggattctcactctgctgtccagggtggagtgcagtggtgccatctcggctcaccacaacctccgcctcccagcttcaagtgatcctcccacctcagccttctgagtagctgggattacagacatgcaccaacactctcggctaatttttgtacttttagtagagatagggtttcaccatgttgcccaggctggtctcaaactcctgccctcatgtggtccacctgcctcggcctcccaaagtgctgggattacaggcatgagccaccacacctggctgatattcctagttgttaagccctcaccaatcactcgttctcagctagaggtaagctccttgaggacttgagctgattccttttcatttcatcctcctagtacttagcctactttacatgaatttttaatatgcaaatgattattgccgctgattaaaataacctaaatacagagaagcctgaaagtgtaaggaagctccttaactttattttggttccttctgagataaggagaatgaatcataacaacaacaacaacagtcaacactgacgttgaaattgttaatatgtactgaacacttaccacatgcacatactgggctaactacacacggcagctcctaatctgttattcctcatttacatccctacatgcagttccctgcatgtgaccctaagaggaccagcttggtgggaaatgttctcagtaaacttggatcccagttccaactcatcactgattaatggtatggtccctttcaatctctctgagcctcagtttacacatgtggaaaatgagatggtaaactcttgccttttctcttttccagggttgccatggaaagccaacgaggggatacagtcagtgctgtgaaaacacatgttaaatgaagaagaagaaagataactcctgcttctgaggcaacaccagaattccagaagcagcagaccattgacttttctgctccagatttggaccttattcatttgcaatatttccaagttgctggttaaatctgaacttatctaagaaacaggtagtaagtgaaagagaatgtgagtcaatataatattggatgcctgaaaagtgcagcaaagcaaaatttaataagtattgacccaaatctttcatttctagttcaatttgacaataacctttatttttcaattaattcagccagagtttccctgagtcaaataccaggctggactttgcaggacctagagctcagccattgcctctgctcctatctttccagccagctttgagggggctcttatccgggagaggagagatattacccaccacatgtggttggagggagcatcttcgttacactcctgcagcatgctggctgccagcaaatggcctcacattctgtgggaaacaggctttctgcctggtgcagctttgcttaagcacaccgttcaggacgtggcctgggagtctcccaaggaatgggccagtatcatttgaatggagtcaataaaacctgttagtcaccttatcaacaatatcagaatcactgttgttcaaaaactgtattattggagatgactccctttgttttgttttctcctattattaaaaaaatgataatggtcctatccccaagaatggtaatatataacatattaatatcatgttatatgttattaccatataccatgtataccaatgtttaccaattggttcctttttctcacaagaaggaacttatgggcctttacagaatacatttcaagccatgtgtaagaacctttcactgcaccatttaatggaatccctgccaccccttttgtatggctggaactgaaagtcaaggatagggagtaactccctataggtcacaccattggcaagtggccgtgattttttgagcacatgatttcatataaatgtggcctttctcctgctattcctcacagctcttctgaataagtgagagtacggtaacagcgactgctcgcatgagagggagaggctgagatttaggccactttgaaaaaaatcctttgcaaatactgacgcatagtcacaatgttttctgtagcatcttgaaactcttgaataaaatgtattatgcttgtgctagtttaaaaaatagtaccagtacccctacatattactctaacagattctttgcagcagagctgatgatagggttatcccttcagactttctgcctacaagctacattaattggatgatgcaaagattggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttatcgcggcactattcacaatagcaaagacttggaaccaacccaaatgtccaacaatgatagactggattaagaaaatgtggcacatatacagcatggaatactatgcagccataaaaaatgatgagttcatgtcctttgtagggacatagatgaaattggaaataaccattctcagtaaactatcgcaataacaaaaaaccaaacaccgcatatcctcacacataggtgggaattgaacaatgagaatacatggacacaggaaggggaacgtcacactctggggacggttggggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataaataaataaataaataaaaaagaaaatgaaaaggaaaggaaatcatgaaaaactatacaattttacaaagcaatcatgaatatcacaaaatccagagaaataaaaatattttttaaattaaaaaaaaaaaaaagaaaatactggttcttcctgtgcagagaaaggagaatacatgccttccttaccaggaagatctacagctattagctagcatggaaaggagaatacatgtcttccttaccaggaagatctagctgtagctagcatggctcactattatcttagctcattagtctttttaaccttttgcctttgcccttgactttgagtcatgatgttgagtagaaagtgaaaaacttgccgaggggttcatttgattccgttgttgtggatatttcattctgtccacttttcctgggcagaatgaataagcctgagttgcttttaatccctgttgctgttctttgatattgaaaaacattctactcacagtcgatctgcaatcaaaatccccaagccactgagaagagatctaaccagatttctggtggcaatttaactccaagttgatgcaatcagtactctgcacaggcaagtgtgatgccattaaaggcttttccccctttgtaggttcacaaacttagcttttgcaagcagtagagaggcatgcaatgtagaagccaatgagattatagcctctgaatcagatttcatacttattaatgcaatcatagccttttgctccaggacttttacaaaaccaacttgacttcttcaaaccaatttgatgctgaaatggtcaaaaagaaaagtaacattaaatgcagggtgcactctctgctgtttttgcttacctttttttcttcccccattctccattttaaaatacgctctttcacagaataccactctaaagttacgtgggcatttgctttcccccaaaattcatatattgaagccctagcccccagtgtggctgtatttgaagatggagtctctaagaaagtaattaaggttaaataaggtcataaggttgggacactgatctaataggattagtatctttataagaagacacgtcagagtgctctctctctctctgtctctctctctctccctacgccctgccccacctatacatgcatagaagggagatcatgtgaggacacagtgggaaggcagccatcagccatccaggaagagagccctcaccacaaaccaaccatgctggtaccccctggtctgacttgcaggctccagaactgtgaaaaataagttgtttaagccacctattctgtcatattttacagaagcccaagttgactaacacactgttaatccaggaaattctaaatattttaagaaatttggtagaagtattagatgaattattcaaaagtccttggaaatgggattaaatgataaaataatactaacgagaaaaagtttgatcctctagaaatgattaagtaaaagatattttttaagtcttaaatgagaaccagcagcttctggtcatgtagtttccttcttaataaaagactaaatgctattccccctccccacacactcccatgtgcacactcatatatcttttttgaataggtgccatctaagtctgtttaaaggtagaaatgtttctgtacaattgagacctaactaacaatatattctaagtgtttgagtgttggatctggactactctgttttactgagttaatgaatttacttttcttatggaagaaagcaagaaaatgagggaagaaaaatctgggtttacttaagtagttgaagatagcacaatagattttcaaaatgaccagtcaaaaaccatgtattctaaagggcccaggatggctggcttcctttcttttcttttctttgtttcttgttttagatataaagtaaatttgttaaaaggcaaagttggcctttctccaacaacaataataatatacgctttgcttactgctacacctcttccaataacatggtgcctagcacagagtgggtacgcagtaaatataagtgaaatatttataagcgatatatagatgaaaaaatattatcaaggaaaaatccagctggattacaaatacatttaacaggaaaaattaaaaagtgacttctgcttttattattgatctacaataaaacttgcagtacaagagattgatataatattaaatatttcaaccataatctatatcaaggtatttttttttctcaaaatgatggtgactcacaaaagaagaaagtaaagaaacagattatatctaggcacttctatgtatttaaatattcaaagaacaaagggcatttaattttatccagatttagaatgacatgttcattatctcaaaactcctttatataacagcaattctgcattcaattatcacaatgtatgtactaaagttattaccatacttattctttccctctgaaatacaaaattttactatctagtaattgataccttgacaagatgtaaattttgctgaaacaaaactatatgttcaaagtcataagaaaccatgtaaggttgagaaatattaagagactgattgctcattataaatgatttatattaatagaaagcataacttttcccatcacctgactttataccacttttgaataactggtcataataatttcatgccagatttaaaaaattaattattaatttaatatgacagcattctttggatgtgaggactctgaaattgtctaacttattgtcttggtttgtttaggctgctataataaaatatttttttgaataagtaatttataaacaacagaatttattgctcatagctctggaggctgggaagtctaagatcaagtgctgggagattctgtgtctggtaaggacctgttgctcatagatgacaccgtcttgctgtgtcttcccatggtggagtggctgaataaactcccccagtcctcttttaataagggcactaatcccatttatgggaatggagccctcatgacttagtcacttcccaaagcccttacctcttaataccatcattttgagaattaaagtttgaaaatatgaattttggagggacacaaacatccagatcatagcacttgctaaggtttcataatgagtctgcatttgaatctttgtctgtttgactcaactgtctttccttgcagtcaagtgtgagttacctgttcctcctctattatccactctaacggcttctgtgtctctcttcagggaacctcagagtggcttcgtcactgattgcacatttacctttttgtagtatctgtctgtttgacttcataatgactaaaagcaacttgagacttctatatggttggaacctagcacagtgcataatattcaataaatggaccgggtgcagtggctcacacatgtaatcccagcactttggtataagcctccaaagtgaggtgggcagatcacttgagctcaggagtttgagactagcctgggtaacatggtgaaatccgatctgtactaaatatacaaaaattagcctggcatgatggtggacatctgtggtcccggctacttgagaggctgaggcaggaggattggttgagcccgggaggcagaagttgcagggagctgagatcgcactccatcttgggtgacagagagagactccgtctcaaaaataaataaatattcaataaatacactgtaatttactgaatgaatgaatgaatgctgttagtaagggccatctctgcattttgcagataaacatgctcattctcaccttatcaatattcccccaaactcaagaactcttctccatgaagagctatcaaaggagagtcattatcaaaaatggaccagccctgattcttcttcttctcctagaaatgtaatttagcctttgccctactgagagtgggccatgcaggttagcaagtagagtcacgggaaacacttccctgtgtttttctcaagaaacaggtatcctttctgtgcaggattttttttataaaggcatcgtgcaagaatcacaaattaacatccctatttccaagctatgggcatatgcattccatgtgatgtatgtctctgagcaaagttatcttcaagaataagtattacctcaagtgaacacaagagctcatgatcaaaaatgatggcaagaaacctggagaagctcaaagtaataaacagagttcacaatccaaaagcaagcacaccttctaaggtgttcaaaatcaacttcttagtattctgtacgaaagaaacatgttattttcatagaggagagttggaaagatttcttaaaatcctgggtctcactcagcctgagaccatgaaatcaatgtggttttgtgcaaagtgaacattacattagtgtttgttgatggaataattgaaattttaaagtcaaatcaatagacacttatttaaggaatatcaagtactctgcagggtgtagagatgattaaaatcacaaataatttatagttcaccttagtcaagaaggtataatcatcatgataatgtaaataaatcgatcaaggtataatgaaacaacaacaagagtgccacaagacattacaaaataatctgccaagcgggtcaggcagcaactgattatagaatacatgaggcattcatacaactctgatagcttcatgcccatacttctggcagatgtcactaattagtcacagggctttatccttctgggcccaggcgcatcctcaaaatctttctcaattttgtgagtttggcagccaattagctacagctggctggcaagataaagtctatttgtcatccctgccttatgctattcctcacatgccatggtttgggtcgtgtaatcctattatgtgccaccctcttcgatttctgggaaatgatctgaattgactcatctttttcaacctccgtcttcagggtcatcctttattgcagagactggaaagtgaaacactactttcaatccctttgcaggtagtattctggatttcagctccacttgaatttggcatggaggggagagaggcaggcccagggtagaggaagcatagttctgtgattgtaactcctggggatggagggttctcgtattgcagtggcagcttccttgagcatggcagaggtctggtggctgggggttgttactagaagcctcacctgcagcctattcattcagcccttctgactagcttctatgccacttaaactgtggtaatacaaccctttcttaaacacggcaaaatgtgtctactgtctgtaactaagtcctaataaatgtagcgcttttccctcaaacagctattaatatgaagtcttcccagaacagagtacagtgggtctctactttcctcttatctagaaactaggtatctgtgaacagacactgataccctgttaagtattggaagcctccaatcatcaattctgcaactaacagtctgcccttgtgtggttccctcatgccctctgagtctcaggttcttcatctgtcaaatgaagggattggttctgattgatggtggggccacttctatcttgagcactctttcaacttgataaaatgattttccagcaagtcccattcaatccaaaatactgaaaaatctacttatcttctaagaaactttcttgaatagagtgaaaaaaaaaattgagtagacatagttgattacctgagagaggtaagttgaagctatttctgagatacaaaccttacagtttaaaaaaactttaggtattccaatttcatttcatagatctggaaactggacaaattatatgcctaaattcacacatctatgggatggcattcagttcttttagttccatattaagtaatatcctccttttattattttaattttacttcagagcaaatgggaaggttatagtgcttattattggaatggaataaagaaggtaaatggcaatttacattatttctcagcaatgctcattagttatgtgaccagcccttgtgccaagccttcttgtgtattcttgacacttactgaccttctaacgcctatcacttcacacctatgtgtgattttctaaatttgattagaccttttttgacagggatctatctttcactcttaggaatcctctatgtgccttacattatatgggcattcaataaatgtttaccagtattcaattgaattacccttaggagaaaataaactttcacctctgtaagaaatcagatgtataaaaatgcataatgttttttaaacgttttctcttgggaggctgaggtgggtggatcacgaggtcaggagattgagacaatcctggctaacacactgaaaccccatctctactaaaaatacaaaaaaattagccgggcgtggtggcgggtgcccgtggtcccagctacttgggaggctgaggcaggagaatggcataaacccgggaggtggagcttgcagtgagccgagattgtgccactgaactccagcctgggcgacagtgcaagacttccttccaaaaaaaaaaagttttctcttactttattattattgcatagttatggctttattcatttcttgccactttatttaaggtgatgttcaaaaatgtactcactgcagaagaataaaacaatagattaaaaatgagagaggaatctaagcaagaaaataaaagcaagttaaagaaatgtattctaaatctttttatgattaataaatatggtttttaaatttgactttaagcatcctaacagccaaggcaagaagtaaaacaacctcttacaaaaaaccaatggccgctatttacaaatttatgagatgctggacaggatagcttttaatagaactgaatagaataatatggtgaaaagaacatgtatcagaagttagaataacacaaataactgctagcatttgcatagcatctattatatcaaaacatttttatataaagttcacttagcctcacaattctgatgtatatagtttgattagtagtgttacaatttttaaagaaagaaagaacattaaagagaaggaagacaaggaaaaagaaagaatagaaaaagaaaaagtggaagaaaagaaagtaaaaagaaaagaataaagggagaaaagaaaaacagacttactggggctaaataactcactcagcaaaacagatgcattaagtaaaagaccaagaacgggtacctcggttttctttcttcagattccacattcttccttcagattccacagtgaccctcttgagagtgagggttctatctagttcttgtcactgacaccactgttgatttataatcatattaatatagcttattgaattgttacaattagcaatgtgtgcttgaatcagacacactatactcattatctctggtcttaacttcataatgtatgatcccattttatagttctggaaactaaggttcagagaggttgagtaaagggtccaagacatacagcttgttaagtagctgatcaggaatttaagcctaagatcttatatctagtatatggcagagagatattatttcattccaggtttgcttggcttcaaagcctatgtcctgctgctaatctgtagccttctcaccaaccaaccatatgacttggaacgagctgtttacgctcattcatttcagtgcccatgaccttcagatatgggataacgagctgtgctttatctgccatgaatgcggtcaaataaggagaggcatatggaagccattttggatactattatagttattttaagtacactaatcacactgtatattaagaacattaatacttgtaatttaatcaccaaactgataaaatatagaattatctaaaaataatggtataatttgcatatgttataggagatatctttggctcttctcatggtattctctgctttctggcctcacatcccttcagaggtgcaggcttgatacagcaaaagacagaaggcaggtgtttggcctggagccctcttaagagatacttgtgaaatgagtcttaactccatcttctgagaaaatgattcaaatcatcgagccaggcaaggattacatttgtaaattttgttaaccttgatatgaattgctactacctgggtctcttgtttccttagtaaccttcctcaataagcattcataggaaagtttcttataggaagtgttatagaaaggactcctgtgaaattcaccagactgaggagattgacttttatggctcagaggatgcagtaggcaaagttcctaatggccagtgaagttcctctttcagagaacacaaatccaaagtgaattctgcaaaatctaccactgtacttattccttcattgagaaaatggggtgctttatggataaatgcatggaaaagtcagacttcgaccaaagtcaaagggcaatagaaaccctttgcattctttctaatgacttcaacctgtggagtttggaaagttacagattcctctggagggtaacatatgtacaggcttttttccctatttctttataataaaaattgatgaagaggaatacgtaaagtgtggtttccctttaggcagagttcagtggaagtagcattatacatagaagaactttcagctaaacttagagagaaacagagacttttaggccaatcattttcctaaatgtcactgattttgtgggagtaagtaatagcatctttcctaggcgtttgttacagaaccacgtaaagagctctactatttgggagatatgcaaacctctaaaataatctaagctaattagaaaatatctgtagctgacaagaagctttgtatctctgacatcaaacagtgcctggaagaggtgtgttggttttcaccagcatgaataccagcagtggcagacaccttcttaccaagagagtaaactgatggacatacacagcctatgaaaaaattgacattgctgagacagcgctggggattaacctttacagctgtgagatgtcaagcaaaattgaaatccaaccattgtggagcatgttgaaatcagtgggtgtatacaaatctctaaattattactttggccagatggaaaaggttccatttactgcctgctggaggaggtttagtcggtaacactgaagagggaaggaagattgaaaatgaggtatttttcatgtgcactaaggctgctatccaagagtagcataagagaggatagtcacaggccaaatgggtgacatggttcacctcttggccccctactacaggtagccaaaataaatgactgtactttgaaataattgcctttagcagcacgtgtttactgtcttctgttattacaattgctaccctataatgtacttagacagcatttaacttgctatggtttcagacagtgacacaggtttaaggcttggctccaaaatgctgaaattgtacacaagtttaaggcttggccccaaaatgctaaaattgtatctgcaagaaagggtatggatgagaattgttgaaagctagtatatgctaattcacagaggagactgattattaaaattctctctccttctatcctaggtatttttcttctttttctacttggaaaactgttaatcatccctaaaatctcatgacacactcactctctctctgatgcattccccagctccagtaaacagttagttgctctatcttttgttttaattacaccactatcatcgcattttatgaggtttctgtttgtgtatctctcttcccaccttgaacccttcaacacagaaaccttatctttaacggagttcaatgtggttgttaataatgagctctgcaaggagaccatgtatgctcaaaccctgatttcacagctgtgtaaccttgggtgcaatccttaacataatctgtaagatgaggaaaatgggaatatccacttctttgaattattgtaaggattaaacaagataataaaatacaaagtgctttgaaaagcaccaagcaccaggctcagttaagtgtttgccattatttcatttttaatatcaccattgtctggcttaatatcaggcatagagtagacagactgtgcataaaaaaataagaaaagttccataacaaataaatacgtcaacagtgtttattttttgcatatttcttccttagttcttcagatagttaggatgaaatgaggagcacatatgataaaagcatgtgttccaggactgagtttgaatgcccccttgtcccaaattggagtgtcttcaataagcctccccttattttcttaaagtattttatagggagtcaaaagtatttgtaagcatgcttatgccctccagagtttttaaaaaagaattcaagcaagaagaggtggatatggttggccaggtttctattaaatgactttcttcagaagcattttgacaaaattaggcacagccaggaaagcagcaaaaaatctgtcgtttctcatttgctgaaaacgccattagctgcctcttctcgccttctgctcacggacacttggctcttgttcctgctctgccccctgtgcccagtctggcagataatgcaccagaaaatatttcacctcatgcacagggagtgggaactcacacaaggaagtttgcaaggaatggaaatctgtgcaaggcaatcccctcgtcctgagaaggaccccatttagcaggggcgaatatccattaaactctgatgaaaacatactcatgcattcaataaatatgcagcacctacaaagtgctggtgttttaggtgctaggaatccattagtgaaccagaaatgaaaacaacaactaaatggatgttaaacaaaatcagtctattagaaggtaatgaggtactattaagaaaaaagaaagggagtcagagggtcctgtaagaaggggcaagaggtgtgcagttttaaatggaaagattaaggaagtctctaataagacattggagactgatcatgagtaggaggcacttatatcagagtttttgcagtttcgaaaatgcattttgcactttggtgtaatttacttcacaaacaagggatgctcttaaatatttgcttatttaataactttctgaatactgagggatattttcctattgcttttccacttcataattaaatatgaatttcttggacaaaaacaaaaggcctaaggaaaaggaaaatagaacttaagagctcagtaaaaaatgtttattttttctatcttttcaaaaataatatgcaaggcaaatcacaaaatgtgaaagaacaaattacttttatttttggattacttaacaaacaaaaggaaaaaaaatctctggtaggtagctcaaataaagaaaacatcctgaattaaaaagctatctaactttatccagccaccatcctaatgttctatcacagatcatgcctctgtgcaaaaaggcctgatttctgagagtttaaaagaatcttatggttttgagaaatgaatacactgatctcttgcgaagaatgaaaaagccccaaaactcagcaaaggcaacaattcaaactaccacaggaaatgaaaaagagtgtgcatttggaacatacacagagttttaaaaaaaacaaaaggaaattgatatagataactcaatttccattagtgtttcataaatttaaattgccttgtgatcaactgagtgcttgtataaactacaaagcgctggtgtggtcccaagatgagaatgtaaaagtataaccagaaaaattaacataggaatcaattaccctgaaaattctgatctcagaggtccctggacagaaaacagtgctccctggaatgacatgaaaagaaatagacaaaatatccatatccacttctatataaagagatactaatgcactgtatacacaacttgggaatatctgcacatactttgattagaagtgagtttataatgaacaatgctcatgtgcattaactcataatactaacactttttactggagattatcaagaggtcagtgatagccaaagacaccttttctcccaccccttcagtttccatgactacgtatctttcctaaaccaccctggcatcacttgactcactttcttcctccttggggaggaatgacttttctgatgggtaaatttaggaaggataaatttcctgctgtgctcaatttctttcctgctttgctcaatttctcctctttgtccttctgggagcaaattgccaaagaagcagaattctccactgcttccaagcctaagtgtcccctgggcaggaccactctcccctacaccgtgaactggggatccatccccatcagcatcactcctgacacctaattgcacacagcgaattttgtgactgtcagcatcactcccgactgggaggctgagtctgcctaattgtggacctaacctgcaggttcttgtgcttcttgcactaaccaaagcctcccacctggcttccatcattaacagagaccttttcttctcgttgcccatgtttctgttttagtccttatttgtacagaactgagtaggggtaaaggtgatgttatttactggctctctctgagggaccctgatagtcagaacaagagatgttgtcaggtatacatacagacatcacagtactaacattgggcatggatggaagcattaaaaccaacaagccaggtttgtctatcccatttacttcaaaaacacaccttaaatttttacttattttatcattttgttcatttgaaagtaaattaaaaaacataaaaatgcacaccatcaaatgacatgttgcagtgctgaaaaatatgtgaagaaaaatgtatagatgagcgataacaggatttataactcagtgacaatctcagctttacgacatttaaattgtgaaatctctaaaagccctaaagtgttgttcaactcatgtcttatccatttcagtttggcttaccataaagtataaacatctagttagaatattttgacagaagaatattggtgagtcattcaatttctctaaccgtcactttgtctgtaaaatggggataaaaaattttttctcttaagttgcacaaaattgaaatgggagcatgatttccgaataggccagacatggtggctcacatctgtaatcccagcactttgggaggcgaggcaggcagatcacttgaggtgaggggttcgagaccagcctggccaatatgatgaaaccctgtctttactaaaaatacaaaaaaaaaaatgagctgggcatggtgacacacgcctgtagtcccagctgctggggagggtgaggcatgagaattccttgaacccgggaatcagaggttgcagtgagccgaaattgcaccactgcactccagcctgggcgacagagcgagactccgtctcaaaaaacaaaaaaaaaaacaacaaaaaaagaaagtataaataataaaataacacactattacaaatgatcatcccttttgtgaactattattattcctattatatgaacactttttttttaaaactcagggagtcatgtaactctgctatatgtatttcttcaagttaaataacaatgatttattaatgaactcctacatgctcttaggaaaggtgctatgtgtactatggattaaaaaaaaagtagtgcatgtttctcacattcaagaagcttttatttaagagaagaaatgcaataaacacagtagaaactaagtaaaaagaaattaggagagtggattttgtgcagtgaaagaggaggttaaaaaataagagggcactagacatgattttaaggataactgagctcagatggatgcaggagagcaggctggtgatttcaggggaggcgaataagtgggaaatattagacgagaatgagcatggtgagagcgctggagtagaggggcaagttgattctctactctctgtttaacagctctttgagctttgttatatttcatcaaggtaaaatatatatataaaaaaaaagatgggtgccaacctctccacatggtgtttggttagatgtggcaaaagtgtggtttttaaaatctatgtaaagaactccatgaatttccaacttattatactctaagtataaaaattgctgaatatcaatgattatacactacaaaagaattgccatttatgggctttattaatgttctagaacctataagtattttacatacttatttatacatgtgaggtcctcagcccttaagacaaccttgtgaaaattggttgctgttttacatagagaagcttgagtttcaggaaaatggaatcactcatgagagaacacagaatgtgtaaatggtggaacaagaattcaaacccacatctgacttagaggcttacccacgatgcagtcaacacctgaccatagtatccaatgacaggggtggaaattagattttgacatgaagttaaaaacacagttaaagtatgtggttcaaatatttaatcattctgggagcatcattctttatgggtgcaatccacattctctttagagaagaaggatattactgtggcaacattcaaagaaagtgcacttcagcctgaagctcagcaagatcgtcttttttgggggggaggtggtaattaactgagtgccctggccttcatccacttttctgatgatttccccagctactcagggttaagcttctgtcacaaaaattattctgagccatttgtttagcctgtttgatgttcactacatttattttccttaggcagcagcattgtgaatgttgactatatttaacatgcttagctgtaccagggaaataatcatctttggcttatttaaaatatccaattttcttagcctttgaagaaaatctagagctaatatggagtaattggtgatgagataggacagatccaagtgcaatttcaaggctcctaattttcacctacagagtaagatttctttattatgttagaaaatgttttggagagattttttcaattaggaggcacattaaacaaatactggctagtagtgtacgggttcaggaagaggggtaaatctcttagttgcttactttctttcaagaaaaactttaaatgattctatttaaccaaagagaagatggagagaaggcaacataagaatgtaattaagtttaacttttaaccttctgtttgggatttgcctctattctttcccaccatagttaagtgtgaagatagtcctcatccatatttagaagaagcctcaaaaagaagcaaaggaaggaaagaataaatagaagtattcactgtctatcctatattcctgccaatatctgggagtggcctcaaaataatacccttgctatctcagagcctatattgcttttgatacactagcagtacttctgtggttttcacggaacacataagccaagtccatgactgaagaccatggcaccataaggaaatctcaccactgacaccatttataatgaaacaaatgggttttctaagaggaggtaactcatggtataactgtcgtggtacaaggtctcaggccaggccttcccacttaaaaaatttccctccatttccaatcttagcaattttacaaagaaactggtcaactttccttaaataattattccaggacttaacttgtgccctaaagaatagacatattctggtctctctggagtgtggagaatgagaagatttgttttcatggaaaaatgtatctactcattttagacagccattggcaagaatagttcctattattgtaaaatgtgtgtatttgaaatatattagctaggcaggtcaactctgaactttacaaagattttgcaactatagaatttctttgctgattttgtgtttttccttaaatatagccataaatgctgagctatatgttagttttattgttgatgcattgtagaagagagatacaataatactgaggctaacttactattttgagctttaaacttttagtctaaaatctcatctgtgcaaattcttaatgaggtacattttcaaagagagctttagctatataacctctgttgtcatgaagaaatgcatttggctaatttcctctgtgtctccttgaaactttacaataacaggaaaaagttaactctgacttttcactcaagtaatgtttagaagtttctgctaattccaacctcaatgcaccagagatatttagggattgctgaatattgggaagatagatgtaggatttggatgtttgttcaggtgcctcagtcttctaattattttgtcattatgcattttcccctgtaatttgtttaaatttggaatcacatcaccaattacttcattgctgtctggtcttcaatattctcttgtttattcattagagaatttctgtgacaggccattaataactatgcatttgctgacgtataaagtcacatatccttaattatgttcaaatatctgtctggggaaagtacttgattctaaatgtactatcctgatcttactaatccaggtaccttagtgtatgtcttcacttaccatagagatttagaaaataaaaaaagaacacttagtactaaaagtaagactagcatagaaaaaacttgagctctaacttcagaagactgtggttgattccaattctactgattgctagttcataatgtagtcaagttacttagcaaatttgaagaaatttccttatctataaaaatggaaaatacctatggactatctcatgtgtaacagaactaagcttattataacttacaaaagataaatattcaaaatcagcataaagaaaattatgtttttggcaactctattcacaatgtttgggattcttcctacctatagttatgtatgaagaagtcacactaaagtaaccattagaaaatctgggttacaatactaggcacttttaatgagtgcttaccatttaatgagtactaggtatgtggcttgtctcaaaattattctgtgtctcagaagcactctgtgaagttggtattatgatgattttcatcttatgggcaggagaactgaggttcagacaggtttggtgatttgcacaggaccacagccagcagcatttctggaaaaatttgacctgtgtatcttcaaagctcagtgtgtcctaaccttagtaccattctgcttctacaactaagttctagtattaagtcataaaaggaccctgggcaactcattactttatcatgacctatatcttagggaagtttgaatgagctttcatgtcttcttgctcaaagtatgcatgattattggtcttaaacttcgtcacatgaacacaataccccacacatttacttgagatgaacatgggcctgcctcttatgaaagatattactctctcgacacaagaaatggaagaacattccatgctcatggataggaagaatcaatatcgtgaaaatggccatactgcccaaggtaatttgtagattcaatgcaatccccatcaagctaccaatgactttcttcacagaattggaaaaaactactttaaagttcatatggaaccaaaaaagagcctgcacagccaagacgatcctaagcaaaaacagcaaagctggaggcatcatgctacctgacttcaaactatactacaaggctacagtaaccaaaacagcatggtacttgtaccaaaacacatatatagaccaatgaaacagagcagaggcctcagaaataacaccgtatgtctacaaccatctgatctttgacaaacctgacagaaacaagcaatggggaagggattccctatttcacaaatggtgctggtaaaactggctagccatatgtagaaagctgaaactggatcccttccttacaccttatacaaaaattaactcaagatggattaaagacttaaatgtaagacctaaaaccgtaaaaaacctagaagaaaacctaggcaataccattcaggacataggcatgggcaaagacttcatgactaacacaccaaaagcaatggcaacaaaagccacaatagacaaatgggatctaattaaactaaagagtttctgtacagcaaaagaaactatcatcagagtgaacaggcaacctacagaacgggagaaaatttttgcaatctacccatctgacaaagggctaatatccagaatctagaaagaacttaaaaaaatttacaagaaaaaaacaaccccatcaaaaagtggtcaaaggatatgaacaaacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaacaacagatgctggagaggatgtggagaaataggaatgcttttacactgttggtgggagtgtaaattagctcaaccattgtggaagacaatgtggcgattcctcaaggatctagaaccagaaataccatttgacccaacgatcccattactaggtatatacccaaaggattataaatcatgctattataaagacacatgcacacatatgtttattgcagcactattcacaatagcaaagacttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactgtcacaagggcagaaaaccaaacactacatgttctcactcataggtgggagttgaacaatgagaacacatggacacagggtggggaacatcacacgctggggcctgtcaaggggtggggggctgggggagggatagtattaggataaatatctaacgtaaatgaccagttaatgggtgcagcaaaccagcatggcacatgtatacctacgtaacaaacctgcacgttgtacacatgtaccctagaacttaaagtataataaaaaataaaaataaaagtaaatagagatattactctctctactgcctccctgctatttaaattcatctaagtaaactacatctactactaagtcccaggaaatatttatttgaatatgcatagcaataattttatgcatgccaattttcctcctaaatacagacccaggaaatacttcatctggtacaaaagtatgttattttttctttccatgaataatctaatgtctgcttagtaccagacttgatggttaaaatggatgtgataattgagaaaactgttagcccttttcataaagggagtgcatctggattgacaacaagaaagaagaacaggaaaactagtttcaagctccagtgagaatttcatacttacagaaaattaaaattcctaatattggtttaaaagccattagcattccagccctaagacaaagtttcttggaatcaccaacacccactaacactgagcttgccaacatgtcattagggctcaccttccaagtgaatcctaatcaatagcctgtcctgacactgcagtgacccaaacccccggttactcctcacattacagtgggacaggtaaatttgtgtgtcccttttgacatgcaaatttgctgcgtgtgtgtttgtgtgtgtgtgtgtgtgtgtgaaaagacctgaaacagttcattctcttgtcccattaattccactctatgactccatcctaagaacataattctaaatatataaggaacttcacacacagataattcattacataattttccaaatactaaaaaaagaaattacttattctaaaatcaggattagtaaactatattacacacatttatagactataatataggtattaatttatgaaaaatctgtaatctaatgtaaaaatacttgtgctctaatactgaatttaaatctatataaaattttatagtaatacaatattattaagtttaagggatcagatatacatggagaaaaaaactgaaaataaacaaatgaaaatattatcagcagtttttttttttttgagacggattcttgctttgttccccaggctggagtgcagttgtgccatctctgctcactgcaagctctgcctcccgggttcactccattctcctgcctcagcctcccaagtagctgggactacaggcgcccgccaccacgcccggctaattttttgtatttttagtaaatacggggtttcaccgtgttagccaggatggtctcgatctcctgacctcgtgatccacccacctcggcctcccaaagtgctgggattacaggtgtgagccaccgcgcccggccagcggttattcttagaatggtgggactgggggtattttcttcatgtttctttcttttctatttatacattttcctcaatgattgtttattacctttgtagtagaaaatcatatacttccccaacactcaggtttcatttccaataattttcagtgctttgatgttttcaaatttaaatttagtttgtaatttatgaatgcgtgtatatataaaggcttacaaattgtgtttggttatacctcaactctatggttctcaatgagggttaggggagtgatctcacctaccctgcacccactggacatttggcagtgcctcgaaacacttttgcttgtcacaactcccagaaaggtgctactggcatttaattggtagagaccagggatgctgtcaatcaacctatagtgccgaagacagcacacaactcaaagaattatccagccccaagtgttcatagtgccaaggttgagaatccctgcctaaaacaaaatgtttaaaaattattaatatattaattcaagcctgttgtgcaaattctgagtagcctattgtattaccagagcctctgaataaacttgcctgtccatgatctacctaacagttcactcactcccacagggcattgaggatggaaagataagtgctctacatatgcggtgcttgaaatttagcaaaagagaaagacatagacatcaagtgtttaatgcagtttgaagtgctatgaaacgggcacttgatctaactaggtggttcaaaggaggctttctggaaaaaatacctcctaagctgagcttaaaggataagaaggagttaatcagaatcatgtgaacacctgagagatgtgttctagaaggaggagcattcatacttcaaagaaaggcatgaagatgaaacagtttagagtgtttggaaaatgatggggagtttgccagcactagagcataagataggcacagaagaaagggagaaggagccatagaagtttcagagccagagcctctttttttctgcctgagaaagtcaaagtatacttctcagtatggggatgagattgagatcagacaagtatgttgatttaaaaagcatgttgatttaaaaggacaagtatattgatttaaaaggacaatctattaaagatgcaattgaagaacccagtaatacagccatacctcaaagatcatgtgggttctgttccagaccactacaataagacaaatatcacaatcaagcaaaccatacttttttttttgttttcctgtgaatataaatgtttacacaatactgtagtctattaagtgtgcaatagcattatgtctaaaaaacaatgtgcaaactgtaatttaaaaatactttactgttaaaaattgataacaatcatgtttcttcagcaatcttgcaaaaagattagcaagtataatatttttgctggtagaactggccttaatgttgttggctgctgctgatcaaggtgatagttgctgaaggttggagtaattgtggcagtttcttaaaataagacaatgaaatttgcctcattgattgaactcttcctttcacaagagatttctctttagcatatgatgctgttgacagcattttatccatggtagaacttctttcaaaattagactcaatcctctcaaatcctgctgctgctttctcaaataagtttatgcagtattctaaattcttagctatcaattgaatgatgttcatagcctcttcaccaggagtcaattccatctcaagaaactgctttctttgtccatctagaagacactactcctcatttgttctagtttgatcatgagattccagtaattcagttaaatattcaggctccacttctaattctagttctcttgctatttccaccacatttacagttatttcttctaatgaattattgaacccctcaaaatcattcatgagagttgaagtcaactttttccaaactcctgttagtgttattttaacctccagtaatgaattgtggaagttcttaatggcatacagaatggtgaatcctttccagaaagttttcaatttatttcgtctagatctatcacaggaatcactctttatggcagctatagccttacaaaatgtatttcttaaataataagatgtgaaagtcaaaattactgcttgatgcaggggctgaagaatggatgttgtgttcagaggcataaaaacaacattaatctcctatacatctccattagaactcctggacaagcaggtgcattgtcactgagaactaatattttgaaaggaatctctttgtgaggagtaggtctcaagggtgggtttaaaactttcagcaaaccatgctataaacagatgtgttgtcattcaggctttgttgttccacttacagagcacaggcagaatagatttagtatagttttttttaaaagtagtgcggacccaaagagtgagcaacagcaagatttattgtgaagtgcaaagcaataaagcttccacagcatggaaaggggacccgagcaagttgcctgatttagcataatttttaagtcaggcaaaaagttgacttcaactctcatgaatgattttgaggggttcaataattcagtagagaaagtaactgcaaatgtgatggaaatagcaagataactagaattagaagtggagcctgagtatttaactgaactactacaatctcatgatcaaactagaacaaatgaggactaacttcttctagaagggcaaagaaagtggtttcttgagatggaatcgaatcctggtgaagtctaggttggaatggtaaatgagtactggcttcaacttaaaatcatcagctgcattagctgctaacaagagagtcagcgtgtcctttgaagctttaaagccagacactgacttctcctctctagctatgaaacttttagacaacatcttctcccaatagaaggttgtttcatccacattgaaaatctgtttagtgtactcactttagctagaccttctaggtaacttgctgtagctactccaatagcacttgctgcttcgctttgcactcttatgttatggagatgacttctttccttaaacctcatgagccaaactctgctagcttcagacttttcttctgtagcttccttacctctctcagccttcacagagataaagagagttagggccttgttctgggttaagttttgaattaagggaaggttgtggctggtttgatattctattcagatccctaaaactttctccatatcagcaataaggctgttttgctttctcattcttcacgtgttcagtgaagtagcacttttcctttgagaactatttctttgtgttcacaatttggctaactggcccaagaggcttagtgtttggccagtcttgactttcatcatgcgttcctcactaagcttaatactttctagcttttgatttcaagtgagagatgtatgactcttccctttacttgaacacttagaggccattgtaggattattaattggcctaatttcattattgttgtgtttcagggaataggccggccctgtggagagggtgagagactggggaatggccagtcagtggagcagtcagaatacacacaatatttatagattaagtttggaatcttacatggatgtagttcatggtgctcctaatctgaactcgattattcctgaggtatatggtataaaaatttctctagtaataccaaagatcactaaaatatatataataataacgaaaatgtttgaaataccgtaaaaaattccaaaatgtgatacaaagacacaaactgagcacatgctgttggaaaaatggcaccaaaaggcctgctcagcagggttgccacaagccttcgctttgtaaaaagcccattatctgcaaagcacaacaatgtgaagtgcaagaacacaaggtatctgtgttatgcctgtatcattgagcctgggtaacacactccttatagctctggacaccgtgaaaatacagggaaaattcaaactgtactaaggtacagtgttctctcttgttcagctggagagaaaatgaatgaacacaaattaagtaatttgagggacagtgcatcaggattcattattaagtgtgtttgctgtaccacgtacatcaggagtaactgaattcagattagaaagaaagggtggtataaaagagagggtgggtttcacttaaagctgaaatggaggaagggtggcacttgtataggagaaggagttctaggaataatataagccaggagtttgaaactgagatcaacatcaggtgttcttggaaatgctaaggtaggttttttcaattgccagtggttctcaaggctgcttgatgctcagtgctaaaagtgttgctcagatgcagctcaaagatcacctctttgagtccgttctgatgctctccactttctaaataggattggtcagtctttcttttatgtccctctaaaatctacatagacgtgaggcccaggcaatttactaaactaattttttggtatgttcatttatatataaacccaatgtagccaaaattatgtctttatgttctcaatgactagtacagttcttggtacacagatcacactcgaaaacctttctttcctggatgattgaatacatgattatgctaataataggtatgatgactatgcaaagcaaagacagcaatgatgttaacactgcaaataatacccaatatttattgagctctgtgtgataggcactgtgctaaggagaattttaacaagtatcatttcatttaaatttcaaaataatgtcatgaggtagctacgactagtactccattttacaaatgagagaactgaggttcaggtggttatatcttcaccaagatcacagccagtaaaaggaaaagctggaaatgaactctaggtctgtctcacttcaaagaccatgatcttatccactacttatagatcttttatttttaagagagtgtagacttaaggtgattttattttattttttaacatttgttcattgaatgtatgtgtcctagactcgaaaggctcaatgtagtgcaacagtctgaatagtaatgtaattttaaaaattaaaatgggtctttaacaaatctatgaaataagagtttgcaaactcaataaaaagagtatattatcaacttctctaagagacaataataccgaaaatgaaaaccaataggacagggcactcaggcattgactcattgtatgacaataccaggcagatggcttaatttatataacaactatctaagttggtccagcagtgtgaagttaggggaaaggaagtcattttattgaaaaaacgcatgtgttaattcaaatcacttgacagtttggcagacaattccaccaaccgcctaaaaagagactagacccccatcccctcaatagtacagaagggatagaaaaacctagttaaatttccaaaaaacaataagtcatcaacctgagacccccttctcaatggttccctttattgccaactctagaacaagggctggcaaaatacagtggtaggccaaatctagtctattctcaattttggtatcacctgccagctaaacattgtttcacatgtaaaataatggttaaaagggcagacattaaataaatatattgtgacatatgaaaattgtatgggattcaaagagcatctacaatgttttattagaacatggccacacctatctgtttgcatattatctacggctgcttttgtgctacaacagagttgaggagttgtgacagactgcatggcccacaaaacccaaaatgtttactactgaaaaagctggctggccactgcttgagaatcaagctcagcaggtgtcagacaacttggcacagaacacactgcagataccatgggtttggcctttccaacttattacctaactcaatggttctcaaagtttggcccctggaccagcagcatgatcctcaagtaagaacccattagaaatgtgaattatgaccccaaccccagatttactgaattggaaactccatgggttgggcccaacaatctgtgtctaacaggtcagctaggtgattctgaagcattcttcagagaacggtagtcaaactcaagaaactggaacatggcaactgttgtttcaacacaattacaagaaaggcacttattggctcctatttgtggatgaagaatggagctagatattccacttatattttagtattcctacaataatcttcaaagattgggattattaaccccattatatggaaaaggaaattgaagcttgggaagattaagtaacttgttcacagttagtgaattaggacttcaactcaaatctgtctgctttatagcctatactcttccctctcgccttattctgccttctcccttattatgtgagagaaggagaaaagcacctgtgggcccctggaaggagctgagctgatttattagttaggtcttggtgttttcttgatgattataaaccatttcatagaatatgaacatcagaaaacaccactgtggacccatggttgatcaatataacaacaagagcactctataatcatgtttgaacagaagcaaaaagatgaactttttctcttttttttgagatggagttttgctcttgttgcccaggctggagtgcagtggtgtgatcttggatcactgtatcctccacctcctgggttcaagcgattctcccacctcagcctcccgagtagctgggattacaggcatgcaccaccacgcctggctaattttgtatttttagtagagatgaagtttctccatgttggtcaggctggtctcaaactcctgacctcaggtgatccacacacctcggtctcccaaggtgctgggattataggtgtgagccactgcgcctggccaaacatgaactttaaaccacaaaataatcaaatacctcctatcccagctaatatgagtaacagctgcttctttacctattacagcttttgtctctgtctagtcttcactacttgcagacacaagttacccaatcacagcatgactctggcttcttgacagcttcctgtccaggtcaatgtcttgctcacttaaaccttctccaaaggcaccaaaatgagctcaaaccctgtaataagtcctaacactctctgagacattccccgtttctctgcagcatgtattctctctctctgcaatgaataataaatgaaaattattcaaccacaggtgtgtttcctgatgatatttggctggagggcattccccttccactcccctcactgcccacttaaaattatagctctcctcttccagcctgggtgaggcacaagttaccaaagtaagtaaaaataattagaactggaaaataatagtccccagactaatcagtatcaagcacattgccaggtccaagcagaaacttggtattttaaataattaatgaaattttcagtgccaatctgattacaaaaatgatttcaggaaactgcctgtcttttaaaaatatagttcaattttctgcttttagtttctagtctctacctgtcaaagttttggatctctcaactcttgagatgtaaaatgtcacttatctttttgcagccttccccaaaatcttctagatggctcctctctttgagttttctaaaggccttactccctctcacaatactttttcatcttggattagttattcatgagctgtctggcctctaaccaattcggaaatttcttgaaggcagtaaaacacctgactatcctcccttcccttccacacagtaatacatatttgttatattttggcaataaatctaaacgtttttccagttacagaattgaaagtgttgcttttccatcaaaccagagctcatataagcggggactctgcaactcattgttggttatcttaattgaaattatctccctggctcaggagttctaacaaacatatgtgtttggtgtgcaggtatcttcactttgccaggggattttgatgtgaaatattactaacagaaaaaatatatatataacaaaaatcttaatcaatgaatcaacagtttttaggctactatggaaacctgaaagtgatactggaagttacttattatgtgggataaatagatatgaactggcactattcctgtatgaaagcaaatggcattcaggtcataattttcttcagtaacttctatttaccaagcactgtgctaaacagcaaggataactgtacaattaaggagaaggagtaaaacagtcaactcctatcctacattttatcgttgttccaggaatttcacgtggtgtatcatggccctgtgcttgtacatggtgttacctcacccagcgttttacatacagtacttggataagcaccattcttatatatcaatcttatacacttctcttcatccataaaagccaggattagaggtcacctccaccatggagtcatctctgattgctttcatctcctctacttggacttaattacctaacattcttcttggattttcttgtactggtctatttaccatgatgtattatattttttatttgttagtattctttttcttcttatgcaactgagaatatcttgaaggcagcaactatctttaattgatctctatattctggagcctagcctagtgcctgacatcctgtagacaatcaataaatatttattaaatgcaagccatgtgaaaacaagtgccaaagtactggtaattattaaagttagataatgaatatatgacaattcattacacttttttctataccttgttttatgtgtaaaatttttcaaaataaaaagtttacaataatcgaggaccttgtaagatagcggattaatctatccaaagttttaagttccttccactatacctatagctatgatctctgcgtactccacatttctttcttttctcataaaaaagatatttaataaagccaaacaaagttgctctgaaataaagtataagtatattgtttccaaagagcttcatgtcatggatatcattaaataagaacttctggaaaaactggaaacggacagttctccccaagtattttattgaggagggaattctgtggatttttgtccttccaatctgccatctgaattgctacaaaagcataactagtatctctgcttccactttctttctttttttttttttttttgagatggagtctcactctgtcgcccaggctggagtgcagtggcgagatctcggctcactgcaagctccgcctcccgggttcacgccactctcctgcctcagcctcccgagtagctgggactaccggcgcccgccacctcgcccagctatttttttgtatttttagtagagacagggtttcaccgtgttattcaggatggtctccatctcctgacctcgtgatccacccgcctcggcctcccaaagtgctgggattacaggtgtgagccaccgcgcctggctctgcttgcactttcttacctgtgaactcatcttcacctacccccaggttgacctacctaaaacatggatctgtcccacttgctcccccaaagttgaagtctttaagtcaatggctcttcaatgtttagggaataagtgtgcacttctagtgttgaaccccaagtaacttgtccagccacatattttaatgttcttagacccatgtgcaacgagccatatccaattcacggtcctaatccatgcaagccacccactgtctgtgcttagattcacagctcaatttccttgctcagcttggaatcttcttcctggattttccaatttgggaaacattctcccactccaaggtcctgtacgactagtttttcttctccattaaaccttctctggagtcctttccagaatgaacctttctacctgtgcttctactggccatggcctgggcctatgcccagcattattttctgctgccttgtttagtaagtagtctcctttaccagaatgtaagcttgttgagggcactttaatgttcatcttgcactttcccaccctctcagtcaatacccaacagggtaccctgcacacgttagaattcaatatgacaagattacaaactaaagtatgaaatgatgagcttaatctcatgagtgttctttctccttccgcttactaataagtggatatgtgcaaaatttcaaatccctatagtaaaatcacactggttgttttgatcttctttacaaattgcttttgagtcctaagtcatgaatttcaattaaaactttttttaaaacaagactatcgaaattggaaactaaaacaaataactgtttctcttaacccttttctatctgtgtctaattctagtcaacattagagatgaaaatattaaggcaatactgctttatctcaacattaatatgggccctctcattcaaatagactcagaagtactttctaatgtattatacagaaaatcacactggagaaaatattccatgatggtaccattgaggtatcactgcttcctgaggacaacatgtaagctcaatgctgcctaaaagaagctcaaatttctactctgggccttttcaccttcacttctccaccataaaaaaaaaaaaaagaggctaattctctggactattgtgggtcatattttctaggtggtgcaatcttagtgaagagtttagcaatttgcattgggataaccctgtcaaccttcatcattttcagctagaaagaatgaaagctctgataatctaattttttatggtggtttgcactttagctgcctttttttctcaaacctttacttgactactgatcaaaaagtccaggttctgtttctgcttagacaatgtcatagtctaaataaacaggcagcaggcctaggatagaggtgtcaccttctcattggacttcatcctcagactctgcttgaactggacattcatcatgattgaatgtaagtcacatttggtcaaaattcagtgcagatcttagatgtctgacaggggctgaggagaccacttggcttgcttttgtcctaatcttgcctctaatctatgacaaacatcagtggtctggcttagctcatttatatcccatgcttgggtcccattcctgggttgaggtcagagccttgtagaaattacatgcccattatatgattttcttttaaatgcatttgccgaaaatatttcacatggtattagccaattcaggaaaagactcaagaattccagaaaattcccatgtgcattttcatttattccctttctcaacattaaggaagatgtataaaagtatgttgtagtaggaaaagcactgtgtaggattcagtagtctttggttttgatcctgcttctgctcgcagttacatttgccttatgacaagtcagttaactttactggattgtagttgtctcctatgcaaaataagagttggcccaaactagtatttcctaacatgtatttcagaggaaaaagggactgactcaacaagtatatgtgggtcttccctcatgtatggtgataacctgcatccttgtattttaacatgatcatggattctatattgaattaaaagtttctccagcttactgaacatttcacataatatctataaatatttatgtacatctctatgtgtatgtttgtgtgtgtagatatagaaatatagattcagatatggataggaatatgatttagatatctctcccaaggaagacttttcagaccaactcaaaatttctatgattctagttgggggagtcaggtttacaattctaattttcattttgttgaaactcaaattcgaagtttgaatctgcaaaccttcaactttaagtgatatgaaacagacattgaagaataaaagctgaatcgttgcccggggccttacacttgggacttttgattttaaatttctacattattaactttgacaatataagaactgtgcgctatcctcataatgctgtgaaagttgacttcctcaatacatttgtggaggttgtcctttagaacctaactctgaaaccaagtcagctccagtacaatgcactgaagttgggggctgtggctcaactaagtccagagaaccaaaacgtggtgacaaaacagaagcaaattattccaatcatagaaattgaaattgctagtactgtattaagacaccagcatttagtgcattgaggcagaaatctcaagagaatgcaaaattgtgtaacattggagaaacctgcttatgcattgatttccttcaggggttaaataaaattactgtgaaatataagaaaaggaaaaagaactaaattctgaggttttaatcccattacagtattatttgtattgtgtctaagcagaacttattgagaataaagaagatacgaagattacaatagaatgtatgttcttatattgtctaaacagttagaacctaatgaacttactttgtagaataaaaggactttctgaagataagatacattggccatcattaacatattaagagaaacaacctgtataccggatcttgtttgggatgatgtcatcatagctatcaggtcttagctcctatagttagaaagattacagaaagcataggcaagtttaaatatttccatctccccacattaaacacaatgtgagaggtaaatattcattacttggcaataaaatatcatatccatatctggaagaaatattagcaagtatctcatggacgtcattctttcacttaggaagaaagaggagattgcatgtagaattgatatcaaatgatttaggtttaaatgattcaaaggctattattttagtaaaagcattatttcataaacaatatgtgtgtgtgtttgatacatacatatacattcaaatagttaaagcaaagttaattaacttcttaaaactctccaatctttgaataacaaaactcattttggatagcaagagtaaaatttatgttagatggatctaatttttattgatagcaacagtcctgtctcgtgtgtatgagttcctactcaggacacacatgagcaatgagactcactggggaatgcaaatgaaacacttgcaaatcaaatgttcaaagcacatttttgctgagcacccattaactcaatttcatatcaaaagcttacccattttatatcataataaaccacccgggttcacccccacacctcctaactaatgagggacacacagatattctcttcacaaatcaagatactctttcataggatgaaatcactaatgacattaaggtgtggtaaccaacatgaacttgacaaccaaataccaacccatattatcaccccataggagagagtcctaactccccaccttagaaaaatatttaacccacaaaatactaaacccaagtagatttcaaatagaaagataatggtacaatatcccttcccttctaatatcaaatatctagataaaccaaaatgaactgtccagccactaggatgctctatgccaaacatgcatattttaaaacttttactttgagtattaaggcttcttaacttctgcagcatctgtatctacttctaaaccagacctgcccaacagcacagactggagcgaccactttaccttccgaaaaatcaatcagtcccagcaaatgaagaagcttcagagatgcacatataatcacaacaatacccactgtttgcagtccttcggactcccactccagagtcaacatcctctgagctggcagagcatcccagcctccagacccctttggagtggagggagttaattacagaatcgtagcaacgtcaggcttggaacaaagacttgcaaggggaaaaagtgagcagctcctggcagatgcaccctgcaaagccggcggccccccggggtgaggacagacctgggctaaagtccagcttctcatgctgatcctggcatttggctggcggggcttcccccctgctaccacagcgcacggacctctccactctatgctgcagccagcgggcgagtacttcgacttcagagctgcgagggaaacgtctgtcggagaactggagactttgcagtgtccgtggcgagaagggacactcctaggaaacttgcccgggagaacaccgcgcgcttccctcgctgaggacgcgaggctgggcagatctgtctgcgcgctagttttctgcctgagaagcttgcgaatggcccctttttgccaaagctgctgctctctcctcccagagccgcctctggcagagagctcagctccctctctgaatgctaggaaacaatcagttctggtggctggtgcctacaggcccttcctgaaagcccccgtggaagtctagaggcagcttttccagggagaaaagtgcaggagcaaagctccgtgattcaatgactttgtcaaacgagaacacctgagcctcccccgccacgccactccttgttctggtctccgctgtcacgtcgggcgcattatcagggagattgatttagtccttatattatatttacaaaggtggacggagggcgtggcggagcagtacccggtaacaactaagatgttcataactgccccctggaaggtgtgtaccaccatcgtcctttaaagtctggcctcagcctttctcaaagtttcacaaacttccctgatgataaaaacaacctggggttgtttattaaaaccacgctcatcagaggagcctggagtgtgtgttattaagaagcccaggtgactcttatcaactgggaagtgtggacagcaccatcgcaaagatgccatgaggtgtgctagtccaaaccactccaaacagaccctgttctgtgccaggaccacactggctgaatcactttgttggttatctccagtctactgaagcccaacctaaaaacggagatgaagagaatcaacagggactctgtaggtgaactggaaatataagggtttgtgagtaatatctcagacctccagggtcatttgcaagttctgcttctttcttgctatgtgatcttgtgcaagacacttaaccactctaataacaggtcctattctatgcagtcaagatcataatacttcatttaaagttctccatttaaagggaattatgggaattaaatgtgatcacaataatagttaacatgtactaagcacttactatgtgctcatcaatattgtagtgacttttcaacaacttacttatccctacatctctacgtggtagacaaattaatctaccacataagtggcagattataagttaattctaatcattttaactttgtaggtgaggaaaacaaagcatgaagaggttaactgacttgccaagcagtgggcatagtgactggaaggcaacaggctttcattcattcagttattcattagcatttattaagctgctactatgagctataaatggtacatgaatgatcaaatgatgaataatactcagctctgtcttttgggggcttatagtttaatgaggaggcaggcatgaagtaaaatgtgaccaataaatacaccaacacttgaacagatgtctgcgcggtacagtgggaaaacaaggagggaaagtcaactctaattgggaaagggtttagtggtatcaggaaggagactttatagaggcggtaactgtccataatggtaacctgaatcattactagaagtattatagtataccatgctcaagttttgaggttggtagacctgggtacaatcctagccttacccttgcttgctccatgaccttgaagaatacactccgtctctgaatcttggtttaaaatgggaatgctactgcccctttctcatggttgatgtaagaattaactaagtctgcggggagctgagcccagtccctggggtcccctgctcacatatggtagttgtggggttatgacggaagttccaactcttcagaggctctgcaaggtctccttggatgaaacgactttgcttttccctggtcctgccacccctgctccaaggtctagtttcagcgtttttcccatgaagacctgctgatcatctcaacccacagtgtggtttctttcccttgagtcctagaaataagttggtcctgccaaaggtgcttttcattttgaataacatatttataagagatatccttgtatccacctgcccaatcacccatccatccaaacattttcttctccattatatcagcaagcctgtggcggggaagcaggttttagtaattagtaggaaaaaaaatattttaggtaaccattttctgaaatttccaccaacgtttagctacagaaagtcaaaagttaaaaaaaaattacagaaattaattaggtcaagttaaatgtaaacatgtcttttaatcctatatcataccatattgtagttgaaaacaactaaagtactgagagggggtcacatggttagaaaacccagaattcaatcattgctttgtctggcttccaaattcacgcttttccctttatttctatcagcagatttcagcaaatatttgccaattgatctcttagtttagagagttggtaaagtattttaaaattgccacatctcattttccaggattgaaattcctatcttttttgaaattcacataaagtcccatgaatatgattttgttggtttcagatagaatttcccttcaggacaatagcattctctacttagaatgtgccagctgattggaggtccagccctttcctatctgcattagttacatttaccacatgctttctgagctgtctctcagctgtggctaccggatcgaatctgctggctcccaagtatgcgggggctctttcacatgcacccccagctgtgagattttgtaaggtgacagcaccataagaggagtttcctgcttcatctaaaaagtctagggaagcaggggacatctggggaatgatgtttatctagcgccactcttggaaagaagagttgcctgcatagcgctttgggaggcttaggtgggaggataacttaggagtttgagaccagtctggggaacatagtgagactctacctctatttttaatgtttaaaaatttaaaaaagtaactccagatcacggctcaaccattttactgcagtaacttgctagccccaacccagtttgttatattaaaacatcctggctttctccctcattcactgactcacccctttctttacattgtaatgagtcctccagcagaggtctgtctttcataccaaagaagggaataccaaaggtacactaaaggcttttacccattgattctaagccaggcaccatactatgtagtttacatgtataaattagtttcagctcaccccaaatcaataggttaggtgttattatcactatttcaaagaagaataaaaactaaggcgcattgggattaattaattttcacaaaattacattcaacaagggacataaccaggatttatacctgatttactccaaaaatagtagctaccaacatttatggagaacttttaagtgtcaggcactactctaaaatatttatagatattggccgggcgcggtggctcatgcctgtaatcccagcattttgggaggccgaggcaggcggatcacgaggtcaggagattgagaccatactggctaacacggtgaaaccccgtctctactaaaaatccaaaaaaaattagccgggcgtggtggtgggcgcctgtagtcccagctattcgggaggctgaggcaggagtacctcgtgaacccgggagacggagcttgcagtgagccgagatcgcaccactgcactccagcctgggcgacacggcgagattccatctcaaaaaaaaaaaaaaaaaaaaaattatagatattaactaatttaatccttttatagttccctgaaataatttggtttcaaggagaaaattcaggctttcaaaggttaatccacttgcctgaagcctcatatatggcacttggtagaactgggatttgaatgtgggtatactcggtaccaggttctgcctactttatcattcaccacctcactctcaggcccctctgcaccatgttgaatggttctttaactggggccgtttaactggttgagagactctgaaaggaaagtattgacagaaactcttaggaaagtaaaaactcactccaaggacgcatgtccaaatcaattgaccagtctgtgaaagagagagggtcagtagactttacatttccttgccccaatccattgtgatcctttaaataatctcaaatgggatgatttatctaaaacctgaaattgatcatttttccttgttttttatagcttcagtttgaaatttcaccacgtgatagtctcggttaagaaatattcttcatactgtttgttgacattataataaatgcaaaaataagtgtagcaagattgagaaaaacgttaaaattcgatatatttacaatctacctgttctctcttcaaatacatagaatcacaatgtatatagaaactagttaagtcaaatttaaatgtaagattattagcctatgaagggaatcagaaaatgttactccaaaatatgtcctttggcataagggttattttcgattgaaggcaactgaaataggagactcaggaaaaactctctaccttccccctctctgcctcaaggcaggggatagatgtatgaatttctctttgtaaagtattcccttctgctctcctgtatgagaaggatgaaacaactataatcactgggcagaaagtcggcaccagtgggatttgtgtaagaaaccttacaaataagccttatattccattagtttcccctgtatatttttcttcccacaatttaccaccctagaagcccaaatccttttttctttgtcttgtcacttcacaatttatcaccctttgttaggatgattatataagtccccaattctaagcacccctttgagttactcttcattgagttctcacatgtatatgtgctctgcacgtgtaaataaactctattaatctatttttcccatcaatctgtcctttgtcagtttaatttacagggtccaactactaaatctaagaaggaacagagaaagtttttttcacccctacatccatattcatacaatcttttaggaatcatttaaagataaaataatatattttttaaaaatttgcaaatgcataaaaaggaggtatagagagcagagttggcttgtttaaggtcagggacttggaagtggacacaggtggctttgaatcctctagcttttcataatccttgacttgcttagtataggaaaaatcaggatgatacactgaaaagttaaaaagaagtaaaattctagaaggaaaatttcttctctcagtcaatagaagctaagagaagcaagccatcaggatggttggcattatccggaaggttgcattgaagagagaaacctaatctaggtcattgaaaatgagtttggagaggagcagtgactttcccaggaacataaatgggcacacacaaagacagcattggccaggcactgtgactcatgcctgtaatcctagcactttgggaggttgaggtgggtagatcgcttgagttcacaagttcaagaccagcccgggcaacatggagaaaccctatctctacaaaaattgcaaaagttagctcggcatggtgacatgggcctgtagtctcagctacttggggagctgaggtgggaggattgcttgaacctaagaggcagaggctgcccgtgccactgcactccagcctgggcaacagaatgagaccctgtctcaaaaacaaaacaaaaacaaaacaaaagacagcattcacgacagtggtaaagccagattgagacctccaagccaggcgagaaaaatgagattggatagttggtgaaagatgccacttaacatcaggacttgatggggcaagtaacaaagacaaggtcagtgtatgacccttcatgtctcttcacactgtaagattttctcaccaaaatgatgaaagttatctacccgcaggtgccctctactctaccctcaacatcacctccacattaaagtatatcaagcctttctatcttggggtttctcaattactttgaaaattcctaaatgttctccagatgaactttctgctcaaacatgatcagactcaagcagtttcacttagctgaaggctcattctgaaaggttagtaaatgtgtcttgaatggacttctttaaaatatgtatatggatgtccattaaactattaagtaccacagccttctgttttgaatgccctattgaatccacaaggtcgattggattttcaaatagaaagctgagggaaaaaactaccttccatcctaagacacttccagcaatattgcactaatgtatcttgaaaatagtcctcatgaatcttatgatcaaagcatgtatagtatgtaatcttcacataaacaaatgagtagactatttggaagtccaaccagaaaacttgcattagaatataagctttccttagtaggatttatgacatttttgccataatttctttttcccagcctttgtggcctaacctgaatgagttcctgggtttacccatttaatccagtatgcaatttgtggctctcctgtcatatcccttttgatgtaatctctctgtaataggtgtctgtcacatcccaccacactgggctggctttaaggccgtgattctccaggataataatgatcattatcccttttatatattatagtttgtagtacaataatactgaattcctaccacgtgacacacagtgtgctgtgtgcattacataaactgtctcattgagttgtcgcaatatctcaatagaataactaatcattaaccccattatatagatcagaatgctgagatgcaaaagcttaagtaacttgcccaaaactacagtgttagcagttgaggagctgggacttgacttcaagaattctcactcaagagccagggttcttacattggaggggaagtatgtgtcaaagtcatcatttttgttttgttttattttattttttactgtggccccattacacaaagagacacaagatttaaaatgcgaatgaccttcagaaaagtaggatgtgacgttaacctcatagtgaagtgtaaatattcagtaactagttctttcctgggaacaaggttaagagagcaatgaaaacacaaatgagatgagggaaggagctcgggatagaggtgagaggaaggagaaaagatgaagggaagggagaagagaggaagaaaagggaaagcgagaaatgagaaagagaagaaacaggcaattctttactccaggcactgagaaatctgaggatacatagatgaatggggcctgtgttctgtttgtgagattctcatagatggccagggagacgtgatctaaaatgaataaaagagggctccaggaaagggccgatcaaggggctatttctccttcaattaatcctacctccgtggtccaccagtctatgcgtctcttataactagaaatacagaatatctcatcagcttcattttctcagccacagcttcagatgaccttggaaatggaacaagtggttttaaaagtatgacaaatggcatctccatggatgttgtagccatggctggggcttggtcctacttctaggtctgttcctaggccctgtcataccttcctgctcatttgggccagggccttgctgccatagatataccacttcatcagcttgatcctcccagttcttgggcacgagattccagagactgacttgggtgtcctcagagctgcgtaagctcatttcttgcaccacaacagtacttgggaaacagaacccagcaggctttggcttaaatgctttccaattctgaagagaaactgaatgaatatttttagcatattttgttgtataggagttgtagagactgtgttagtccgttctcatactactatgaagaaatactcgagactgggtaatttatgaaggaaagaggtttacttgactcacacttcctcattgctggggaaattcccatggcctcaggaaatttacaattatggcagagggcaaaggagaagcaggcactttcttcacagggtggcaggatggagtgggtgcaagcaggggaaatgtccgtcacttgtaaaaccatcacatttcatgagaactcactcattatcatgagaacagcatgggggaaaccacttctatgatccaattacctccacctggtcccgcccttgacatgtggggattatggaaattatggggattacaattcaagatgagattttgggtgggaacacagccaaaccatatcaagattatatggaaagaatatttcatatagttcccaaaactctcctccccaaataattccatgtgctttctcctgtctccctccctttctgcctctcccccaccccacatacaattatcacccggatcggatcattttccttatctatgagattagaatgggtgaagtctcaatgacttggaaatccccttttcaccaaccttagagccctgaacattctcaatggatgatgaacaaagaaagcacagagtaggccgaacatggtggctcatgcctgtaatcccagcaatttggggggccaaggcaggtggatcatctgaagtcagtagttcaagaccagcctggccaacatagtgaaaccctgtctctactaaaaatacaaaaatcagccgggcgcggcggtgggcacctgtaatcccagctactctggaggctgaggcaggagaatcacttgaacctggggagtggaggttgcagtgagccgagatcatgccactgcactccagcacaggcgacagagtgagactccatctcaaaaaaaaaaaaaaaaaaaaaaaagagagcacagaataaatgtttagagaatgcctaccagaatgcagggcatgggtcatggtaggccttcactctctaagggctacctatctgaggtcatggcacaggactgggagccagacatgtagcctggtttttggaccattagtccagttctctttccactgcaacagggtatgaagatgtctatataatagctaagttacaagcaaaaagggaatatgcactatagaagagatttcttatagtgagaagatcaggaaaatcccagagaaagagaagacatatgaactggtcatgaaggccaggattaatatgacctgtgtccatattactgttcatgaatgcaaactcttgctagtgctccctaaatcagaagcatctatgaatagcttccaagattcattgtaacccagcaatcagtgaagctaggggtcacatcccaatgaatcactttgacaaaagggactaagccctcttaaaagaagtagaggaagaagaaaagtttcccctacctcagcttcaaatacagaggcccagagaactggaaacaaaatcattcttctgggaatgagttttcctagaactcacagtcagtgttgcagcttatgtgcctgagattgcttattttctgttattgtacccattactataatgctgaaatcagtttgtatttgtttcccgttgctgctatagtaaattaccacaagcctggtggctaaaactgacacaaatttattatgttacggttctggaagtcagaagtttgaaatggttctcattgggcttaaatcaaggtgttggcaggaccacgttcctattggaggatctaggagggaatcaattttcttgccttttccagcttctagaggctgcctgcatatcttggcttgtggccccttccattgttagtgccagcaatgaccatttgagtctttctcacattccattgctctgacactgacccatctacctccctctttcttttatccttgtgattacattgggcccacctaaataatccaccatacaattcttattttaaggacatctgatgagcaaccttaatttcattcacaatactgattaccttgtgtcacataacccaaaataacacaaatttactatttcacaattcctgggtttaggatatggccatctttggggtttttattctgcctactatatagatgtaatatattagttatttttaacaggaaacactctttaagaagaaaaaagataacataaactgaagctcacgaagacagagtccactttattaggaacaaactagttgaggtaagtgcatgtgagtgtgagaatgagtgtgtgtgttttatttttaacatacagaaaaagaactttgtctttgagaaggaaagggcagctttaattagcattcctatttctgaactaattgtcacagagaaaggactttgaggaaagtacatttcaaaatattaaaaagggaacactaaacaatttagagtgtataaactaatgatcagaccgagggacactctcctttcattttaggtgcaagcccagacatgaactaggagttacagggatagaaccctacagtacccagaactgggatgtgttcttcccacaaagaatgtcctagaggattacaaaagaaaagagaggagaaactactgcataagtagagaaaggcattcgcatgttatcagtcccatcagctaattcagccttcttaggatggataaaaccaaaaatgaactaaactcttcagctactgagtttttcatttttagttcaagtgtgcaatgctctgaacatgagaaagccatagagcatgactttcaaagacatggtagcaattaaactctaggaaatggggggctttatcctttgaagagccataagacactttctcctaacactgcctttaaatgtgcttgcatcttatacatttcagttaaaaatcagctctaaccccttctgaatgtctacttttattcatgattttcctggagtaagtttacctatatttacacttttccaggctttctctcacttgttctttaccgtaggctattttaaaatgagaaaactgagactaaaaaggtttgcatgatctgaaatcaaaaatggctgcaaaacagggttaaaaacaggcattctggctccatgccaattttagattttttttcttttctagtcttatagagatctttttctctgttgggtgctgtgggaagtgctttatatcagcgacttataaaatggggataataaaagcatctatctcacagtgctgtcaggggcaatgaatgcgttaatgtagttaaagcattcattgcaggcacaaagcaaacactctgtttctaaaagtaattatttttttagtagccatctctgaggtatttcgattattatgcccatttgaccaataaactgtgatccagaatggttaagacacttgttacaaagctggtaagtgaagctggaactcagtcctgctatgagaacccgttcccatttgcacaagccacactcacattgcctctctggtttcaaagaaccactctcagtcactcagctagttcttggcttccaagcaaggcagagcctaaactaactgagctgtattattatacttcatctgtttgacaagatcctcagatttcgatgccatcgctcagtaatctcttctttatctgaggactttgacctttgcataatttccacctcactgcatttgtgcaaaaaaatgttgacaccggttatgtaccatgcaaaatatgcaagggactgtggggcatgaagggtgtgaggaagcttacagcccagaagaaaagggaaggaatgcacataagttactaagtccaaggaaaaacattagtgtccatgagaaaatgcgtttaaagtgtggtaggatttcaggggcaggagaggagtaagaaagtggaagggtgatgttagtcagggagtgttgcatggagtctgagcttgaccatgagtggcagctcaatcattcctttaatgagtcaattaacaacacttatgtctgctatatgctagaatatgcaagaccctaaacaaatccaatcaacaaatcccattggttccacctccaaagtacattctgtatctgaccaattctcactaaccctgctaacatagccgtaggcccaagccaccactcagcaaactcctgtctaattttgttactttcgctctcacacccctaaggtctatttttacacagcagccagattaaagagcatatctttcatataatttccctgcttacagtccctcaatagctgtccattatattcgggataacattcaaacttctcgctgtgttttgagtcctcttggatctcaattcagaccaatgtaatcctgtcccacacctcctcatcacagttctctgcccacatagtctttcgatttattaaataaactaagactatccctgccactggtctttgtactttgtgatccccatgtgatgttctttaccccaagattgtccccttatttcttagactgtctccttattcttttctctttcttgccactcacttctaggctcaaatgctgtcttctcagagaggcctttcctgaccacactatcagaaggattctgtgtttttgtcaccactccctggttcctcttgatcaaattgctgtttttttatttaattttctccgtagcactcaccaacctccctgaacttcttttttttaaatgcctcttagcacgttcatttcctatctcatcccacttgtgtagatgctcctcacatgtgggccctttaccgacctcattcatctcactgtctccaggaactaggagagagattgtcagttacaggctttctataatgatttgttgaatgaatgatggcataagacagggttctttcctcacgcaggcatttgaatctcatgaagtgcatcagcaaaatcataatcagagactggcaagtaattttattaagtagtgcagtgggttcaagggagaattcattagactaggatggggggaaaactacgaagacctgcaaatatctataagagagtggaatgaggaagatttaatgatcatttcaggcagttgacaggcatgatcatggcagtatctggtccgtttcatctggtaatagcgcaaataaaagcaaccacaaccatgaaagaaaagagaaaggaaacaagagacaggaaaaccagtgagtaggctgttgtaatggtctataccagatgtcctatcagtgggcagaaagggactggacacagaaaccagcaaagctgcaaagctgaacccagcagagcatggtagcgtatgtgaaggctgaggcttcacatgtcctcagaggctgaggacaggaggtatcaaaggtgatcttaactgatggtgaaacatgttggacgtattcttcaacatttcactggctctgactagtgaaataattaaaaggtattgtagggaatctgggataactcattaacacgaagaaagaactgcacaaccaagacttaggaagggctgggaaagaggacgctgtgaatgacctgcagcaggaacttgctgacctctacctgagagggctgcccttagcatgcttctctctgggtgttcttgaccatggcatctacccaactcccagtcttcaagtttcaaacatcaacgaggaagattctgtatgtaggtcagacgaatgccgttggatcaatctgttattgtctggatcaatctattattgccaagtacaaaagagcactagggacccgctcctaatgactggggtccttttaggacaaagaaaactcttgaagggccatacagctgcttcaagtcacctcgggtgaaattgaaaacaggaacgtgtagagaggtgaagataattgaatttttgataaagttgttcttgagaaaccatcaggtaatccaggtagagctgttaagctgataacttaaaatgtggagctatgccttgggaagagggccagagtgagagagaagataatctgggattcatccacataaaggagataattgaagtgacagtagtgaatgagatattcagggaagagagatagaaagagaaaagagcaaataatcaaccttccagaagaaagggtagccaacagtgccagagcaggattagtaagtgagatgtaaggagaacctagaaagtaatgtttcatgggagtcaagagaagagagagcatcagagacgctggatcattgagttcactgtagaagccctatcaatcccaagtgaaagtttcgtcccagcaccaattagctttaggcaagtgtgtgtacaggggccatttctatgtgtgtgtacatgtccagaggactgaagggcaggggtggaatataaaagataatagttaaaaagatttcaaccataacatgtgatctacaataaaagtctatagccacactattgattacctataagggaaaacttccataaggcaactagactttgcttttacattattttgacaaggttcatgaatagataagagaaagtagatctgaggtccattggtctactgaagttgtcttcaagtctgaaagagtgaagggctgaaattttaattcacatctcattccttttaatagtctggcttaaaaataagaaaacacttgtctcttcatcagtggcagaagatgaggacagggtcatagatctgaataaggataatagttctttgcaaagaagtactccaaatggaggatgactcaatgtcttgacaccagtgagaataaattgcacagtcggtgcacttaattgtaaagttcttatgcttttttattcaatccaagacaattcaacaagtattattgagcatccagtaagtgcccaacattgatgcaggagttgggaatatgataggtacaaatgagccagctcttctttcttggagcctacagtcaaatgggaaatgcagaaaaataaagaggcagttattaaatattatagtgagagcaaaggtggtttcatcctgggagctcatttcacagacacttaactcactcttcattctagacaggttttctgacaaaaagacatcatctgaacagagctcttaagtatgagcagggtcagacaaagataggaaaaatctgttacttatagagcaaacagtggtttcaacagcttggaacctagagggagatcatacttcatcttagacataggcaagagctcagtttcctgagtgagtgtgtttgggtaggaataacacaaagttgatgaattagacaggaataaatcatatttcaagatacagggctattaacgtaaacaggacacagatcacgaagggtctttagagcacccaaaaaagagggtttttgttgtggtggtgttttttttttttgtttgttttttgttttttttttttttttttatcttgagagcatgagagagccactaaaaggctataaacagaggcacacagcatcaaatgtgtccttcagaacgatcaccgtggttgctgtgtggacaagtgattgagggtttgggggaagagggtggctggtctaaaggtaaagggactaattaagaggctgtttcagaaattcagggacagatgatttaggaatgtggcaaactgactggagagacttgaatggatgtgacagatacagacgtgatgaaatctatagatattgaaaaccaatgaaccactagggctggagaggaaaagagtacaagatgatattcaagttttcagaaaaaaaaataccatttctagttgaaaattaagaggttatttgcaaaactaattacagtataaaagactaacaaagtgtgcaaagctctgaaacaagaaggaaacagaacatgcacgttgcaacttagaattttctggtagaggcaacttaaccttcccagagtattcatctccacgtttggggcatccagccattgccaaggaagggcggaaaaaaaagaattgagaatatgtgccatgtgagtgtttgttcatgaccatttaaaatcagatgcttctgcagtgtagacccttcctacgtcccttgtcttagaatggtgaattttccaggtaggcatataccatcgattccagcaggtgctaagcagaaggatctgcagctaacatgcaaatgattagcaaaaaatttggctaattctcagtaccactgccaactccagaccaaaaccaccatcctctccttcatgactcctctaataagtcgtctcagccgctgcccttgtctccccatattctattctacagaaaaaaaagatagagtaatattttaaagcatagatcaagtcatgtgactcctctgctcaaaaccttccaatagatcttactaaaaaaagaaaaaaaaaagacacggtggctcacgcctgtaatcccaacattttgggaggccgaggcaggcagatcacatgaggtcaggagttcgagaccagcctggccaacatggtggaaccctgtctctactaaaaatacaaaaattagccaggtgtggtggtgcatgcctgtaatcccagctactagggaggctgaggcaggagaatgacttgaacccgggaggtggaggttgcagtgagccaagatcgcgctgttgcactccagcctgtgcaaaaagaacataacttcgtctcaaagaagaaaaaaaaaaagataaaatcccatttaaaatggggtatgtgccttttatgataactctttgattttttgtctcactacacaccccttactcactccagctacagcggtctccactatgtgccttgatcatacagacatgcttctatctcagggatattgcacttgcagtttcctcttcctagaccttagtaagtacagcagctaccttctctcaaattacatgcttccactcccaattcttcctcacctcttccaaacccttttatactttttagcaattaccactatcatataaactacatattgtttttatttatcttgtttttcccactaggctctaaacactattaggcagaatttttaccagctttattcatgattcccagcactgagaacagatttgacatgtagtaggaggttgataatgagttaatgaatgttgctgaaatatctaccgaaagcaacaaacatttaccttcatgaatacacatggtttccccttaattaacatacatagatacaatacatcacccttaaatattttgtattgttatgttaatagagaaaaaagttcaatttccccttgggagaaaacactatgaaattgcttaattgcttatgaagaaactgaaaatgtaataagtaactaaagttctaaaaaaatttgagtgaccacaaaacccctttaacctgccctccaagtgggtcctgaaatggaaagctcttaatgtttatttgggtgataagatggatttggccagttcattttggatttgaactgggcgaggctgaattgccctgcctaatagaggaaggtgggatttgaagtggcctacctcctcctgtttcctgggtggagctgacttggttctgtggatgaaaaaagggatgaaaatgaagaaacaggaaccagagaatgcactctccttaagcaatgacaacagtaatttattgagtgcctactctgttaaagatacggtagcagagtcctcacatatattatcccacttaactgtcacaaggactctgttaggtgtatattatctgcacttagcagataaggaaattgagagaagttcaaagtgctttcgtttttgcacacaatttattggtgctgggattgaatctaatctgactgctgtaagaccctctttctccaccaaatgacgtttatttgttcttggaacctctcgttccttctcaccacaaagtagaaggcatttttcttcagaaataactttaggaataataattttgtttccagtaagttcattaaaaccctttgtaacttataatacagttgaaaggccaacattgtttctaggaaatgtgagctgggagctttaaactgcagacttaacaagtcaactttgttatagtctgtttccctcttcttagaggagataaataggcagcactgttcaattactcaaactcattctgtgtttcatctttccagatagcatttagccttgctttattttttcccaccattgaagtacaaaagctgcctggtttttcactgcacaaagtaaatgatgagcccggagccaatttctcatctcagacactgcagttttcaatgtgcattctgaaagctttgaatatgactataaacacatcaaccaaaacaaactgtaatttttataaaataagcctcagagtatgttttgctgaaacttaacaccttttgtctaagggaaaaagcagaaaaggcagtaagagcagaatactcgtactccattcactggcagtgctgaatcccatgtaaaatctggtagtgcataatcaagacatatggcctcatctttctttgccacttcccaggagtgaggtgtttaagaaaactgagaactcttcctggccaattcagaacggggttgtctgcagcaatgctgttcgaagtgtggcatcagcaatacgtgggagagtgttaaaaatgcaaattctcgggcccaccccagacctactcaatcagaatctctggggtgggtgcagcaatctgttttacaagtactctggatgattgcgatgcaagctcaagtttgggaagtataaactaaagggaaggaattccacctgaacgcagaacaatgggattcaagtcactggaacatcaattgacagagaattattctgagataagtcctttaacctctctggcttctgtgtttcttatctttaaataaagaaattgaaacattttaaccctggatcacatcttaacctattatcagagcatatcatggttacctgacactggtataaacatccctcacataatgaaagatttgagtatcattttctgactgctcttattttttctagctagcatcataatgacaatcacagcaacaacatcatgggagggcctcctgtgttcgtgtaccatttcccaagtttaacacgtttgatctgctgatgtcctctagtagtaatatctccagtttaggactgaggaaacagagcttatgtcacttcctgaaggtcacaaagaaagtaaattacagggctgaaatttgaacccacatctgatttcaaaatctgctcctccctttctaccaacgtctatcttcccggaactggtaactttcattaatgagaggaagaaaacaaaacaaaacaacacaatccataaggtggggctaagcagacctcatttctgtgaacagtgtgattccttgaagtatgtaaggcaattactttgaatacatttaacacacgtattgatttcatataaaagccactttacctaagagtgatcaataaacaacaaagcttacttgtagttgtactaaactgctgatttattgacaactctgagatattttgtccctggtgaaaagacacaaaaaatagaaactggagagaactttggaaagcttctgccttaaagaggttaccataggcaaaaggaaatttagaactagagaagcctagcaatttatttaaggtcacatggctggttagtggcagaaatatggttggaatgtatcttactgcccacctgagttggggttattgctgatattattttattaagtgaaactggatattgtttcagaggaagcttataaagaagtgtggtagtgcagattcttcaatgataagccagaattactcacaccaataaagttaagatgctaattctgggcagaggcaacagcctaaagcaaaggtatggggggtctggaatcgcatgatgtgtttggggaacgattagaaattccatattactaaaaaatgaaaaagtacaaaccaggaagcagttggaaatgagcctgagaggtatggagtattgaggttatgaaggactgaatatgtcatcccaaggcatttgatgttcataaggggttgctaaagaattggtgcaggagaatggcatgaatagatttgtattttagcttgctttggctatagtatggatttaaggggtgaggaaaggaggaagatacagcatccaagactaaaaaagtgagatgagttgggcttataatattccaggcagcaaatggtaaagtctgtgcaatgtcaattttacaagcaatgaagtagaagaggaagactcaaaagattttttgagaggtaaaataaccacaactcagtgctcgattcaatgagaaaggagagagtatatgggcgactcccaaatttctaacttggacaactgatgaatggtgatgacatagggagaccaaagaggaatacattgggccaagtggaaatagtaaaactagtattgagttcactgtatccctgcaccatcgctgtcaagatatcctggagagacagtccacacagaggtgatggtccataccattgcaatgtgtgagactccccaaggcaaaagagtaacacagtcaaggtgagagtcttggagaatgttacagaagaggaggagcctacaacaattactgtgggagagaacaaaggagttggaagcagagagggaaagccttgtgtcaaaagccaaaaataattttctttttcacacttcatgaattataattagcttcaaattcatagagttccacggaagtcaaaagtgacttcatttttgcaatatgggtgtcactggtacagaagatcagtaaggatggaaatgcaatcacatggagacgttagctgcagaattgaaacaggtgtgtttctgttttacgggattcaaaaatgctaaaggggagaggacaggacataggaacaaagtggtgcaagcatgacatataaacatattgaggagcaagcagagaggaagaagtgaatgtagggagagaggagacaagtgatagaacatctctgaatgtggagggaccaataaggtgttatttggctttggcttagaaaaactgagactcatgtgaatagcaaaagtatagaccttttcatataaaatattgtactattacgggagttaatgcttatatgacaggccagaggttccttgtaaaaacaaacaaacaaacaaacaaaaacccaataaaaacaggggttcccagattataatgttagctgcagatcagatgtttggaaaggccacgagtttcccctgacatccacctggtcacatggagtggctcagtacacaggcagagctggccacgtgttttccctgctttggtaagccagttacctgcttctcaaataatcaggagaatataatctttggcagtgtgggtatcatgcagataaaactaacaagtaatcattggggccttctcactttttcccacttattgaagttttttctgaataaataccaaaaagcctaatcatagaaagctttaattggctcaattctaattaatatacagatgattaagataatttatatttcatatttatttattacgtgaacttccttaaaacacagtatctatctaccatttttttttctacatataacctgcctgagaactcagaccaaatgagttcccaaattatgctggacagtaggacaagtttgatgaatttcaccataaatatggtttggcacaactttatttgaaaatagaattatagaatttaagaggcctcatatccggaatgcttatatagtttgaatgcagagtgactttggttatagtgaaggaggaaggacaggccctcagttaggtgtctcaaataccttcttatttaattacagcagcatctctaccagagagtattacgcaattatttttatcctaaaacatactctttcccctgacatttgcattttttctgaaatttgcatgcaaactttggttgatctactcattaaaaataatgtttattcttcgcacctcatgcccttaaaagtatttatgtcaataggagagcaatagagagccttaaaatggaggcgattgaagcacagagagactacgcatctcaacaaggtacacaaaccagaattagtagagccagaatttgaactcacgtctatctaacttgaaagctggttaagagcaaatctttgctatgtagatgaaggcactatgctgggtcctgataaggcagcacctgcccttaagaaacctgcatgcagaggaggaaatggacactaaagaataaacaagtagataagagaaatttagatgctccataaattctacaaaggaaataaaacagggtaaggtaatagaggcagattggggagttgcttcttgctgtcctcttccaagaggtaacttttgaatttcttcccattcttgtaaaattgggcaacagcacataccatgtaaaagaagaggacttgcataagccgtaagatagaaagaaacttgcttttgaccaactgtaaatcagacattgccactcctcattgtaagctctaggtgtctctttttaagggaccataatctactggggaaaacagataagccaaattatatatgatgttgttatacatcaagagctataatggagatgtgttcaagattctacagaagcatggaagaatggaaatttgctgtcggtagaatgagtgtttcagaagtaaagatgggagttaagttggtcttgaagaaataggattttgcccaggacatggggcagggaatgggtaagtgcatgccgtgcctgggagatgtgtctgtgtcatgtaacacagcatggaagtctgatgaaggatggcattggcagttgtattgtcatggcggacctaacttggggtgcagaatggggcatgacaggggatgttctgaacaagatgtagcacctggaaataattaagcttggcaaggtctcacaataaattctctctgttcttgaggacaaatgtcactgaaaatacttcaagtgaatttcctggcagtgcctggctgactttccaaggtctcttgctgaataatgtagagggaacactgtttgagtcagtggttctcagtagaatcaccagtagaacttaaaataatatgaacacaaatttaaaactttaaaaaaatacccttgaataattaaaatcagcaggtctgggaatggggattgcacattggtgatttttaaagatcttcaagtgaatgtaatagtcatccagcgttgaaaggcactatttctagaagacttggaagggaaactgagttttcctgaaggcctgagacaccgtatatggcggaacctgtacagaaagaagtcatccaagaaaagacaaggaactgacagggactgatcttaggactggcagtgtccatgttccagggtttagaaaaactcattttttaaactgttgtgtttacatagtagatgtatatatttatggagtatatgggatatttagatagactattgtcaccctgtcatgctttcaaaaactagatcttattcattctttccaagtttttttgtacccattaaaccatcttctctactctgcccccgacccacccagcaacttcccttcccagcctctggtagccatctttttactttagagaaagtcattctgaaagcaaagcaagtgaaagaaatgtaatctttaggcaaccaagctctgaagtctaatggtgagatccgaatttaatggcgctctgaatactcctcagtaattatctcagaagaaaacaatggcgccaaagggaagccctgattttgaacagtcccaggtgacagtaaatgagaagtaatctgactaagaaaccaacggagagtcatcccttgactttcttttccataatgacacctgaagcacacttgtttattctgtaaactttagttaaacaaatttaccctccaagacactgggggtttgccagagaacagttagtttaattggagctcatctgtttttgttcctaatgagcctcccatttcatagcctgctcctagtttgaaataaaatgtcccccctgtctgggatgattaaaaacctggttaagcatacaatatacagtagctgccaaaatgtttccaccaggcaatactgctcagaactgagacctgcaggcaggattagaagagagaaatctgttgattttttccagctcaaaaacaaacaagcaaagaaatcacatccaattatctgagttatattttattaaagaatccaccggagaactgcattcacttctcaagatttgctaccaaaccgtctccccattctgtcttttaaacactcctccaccctttttgttctctagttggtttgtaatttagaaagtgtgataaacaattttggggagccattaagttttaccagtgtttctgtctgaaattaggctactatgtttgccaaagagctgctctgtgctataaaatctttattaaaaatacaattatttacaaaattattaatacttatggattagaataaatgtgacttcatcttgcagctatgggcattttctttttgtttttgtttttgtttttttttgagacggagtctcgctctgtcgcccaggttggagtgcagtggtgcgatctcggctcactgcaagctccgcctcccgggttcacgccattctcctgcctcagcctcccaagtagctgggactgcaggcgcccgccaccacgcccggctaatttttttgcatttttagtagagacggggtttcaccgtgttatctaggatggtctcgatctcctgatctggtgatccgcccgcctcggcctcccagagtgctaggattacagacgtgagccaccgcgcccagccgggattttctttttaagaaactgtaaggtgctaatcattgggtatttcattaggagacacatttaaaaaatctgattctccaagcactttgttcttagactcccacatccctttcaccctcccccaaattcaggatcacaggatttcttctgtctgccttatgtattttgcaagctaactattgcactagaaaaaaaatatctttcacaaataatacagaggcagatgttttctggatcataatgatcaaatagagtgagctaaattgctcattgatctgtgattccttgtcatttgaaaatccgattaaaagtgtagaacttttagaaaagacaaatatacacacactattacatacatcataacactaagcgtgaggagtgggattcatgttatgaatacatagcatttgttctgggaatagcaaaaggttgatactcaatacatacttatccaatgaataaatgagtgaataaaatttcaggatggatttggatggctttgcaagtgagtgtcaataaaccctgggttcagagcctccattatgaacgaaataattatgaaattgaattctcctgatttcttttggccttaaagactttctttcctttactgtgttaagggttgaccatctccttcctttccaaacaattaaaatgtatggagggcatatatgtttgattaggttttcatgtagagaattacagttacttccagcctgtctcatgatttccttgatgggatatttggttgttcctaaactcctctgtagtgcatttaattactatctcatagttttcctaccacatgtctaatgtaatgcattttattcttacagcttcattctcaaaagacatcatttatccctttatttccaagttcctagggcattttagtacatgtcttgacaaaggacatatcccttctctgctgctggaatgggctgccgcctctgagctgcttcaggcacgcattctgaaaagacgttcacacagggaaaaattccgttcaccttccttctcattcaaccgtcctgattttgtctgtgccattttaaaagacttgtgtgcctactttctttgtcagctacatctgccataacaaaataccaaagactgggtggcttaaacaacaggtatttctcacagttctggagattggcaagtccacaatgaagatgatggccagtttagtccctggtgagggccccactctcatgacctaacccaaccctaattacttcccaaaggactcttcttcaaataccctcatactcgaggttaggacttcaacagtaggtcacacacttactgctaattaaggatgtctctgaaagctgtagggggtcacagatgtcactaacaccaaacaatgaaaaagcacaaggcgtcttctttgattcgttgttataggaacatgtccacacttccctccctccccttcgccagtcactgaaagaatacaggatgtgactataaagtgatgtctccaatttttaacatttaaaatagaaaagaaattgtacatttaaagaaaatatggtgccttttcaagaagtcccttggggaaccacactcttagtctaatgacgcttctgaatggcagagcacctttttttaattccccaaagaaaatgcctgcagactttgtggcgtgttctttcgaacgtccgctgccaggaaaatccctgacctttatgcgatgaatttgattttgggaaatagcaaaattgcctttggagacaagttttgcaatcaagttaagtgatcacaccagagaattctgcttcaggaacaaaactgggacagataatagactaataagatgccttcaccaccaggcttgtaaaacttgtcttgagaccaattacaatatagaccttttcaaacttatttttagcaataagagcatagtatggttagtgtgtaaattaaggtaaaaatattgaaacacaagatatatttgaaagcctaagtaatcctattttttagtttaacctttccaagactgtctttgcacacttggatttttatttgaaaataacaccaatttgaaattcatactaattgatgctaccacttcaagagttcatgaaaccaagcagtttcaagtgaatttgcgttggatcaccctgtcctgagagttaccttttggaaaacataacctgcacatatgtctcatttattctactcaatgcctcccgatgaaatcagtagcaacaatatatgcatagtagcgaaataattgggcaaaagatgaatcataattttgattgtaattgggggcagtgagagaggaggaggaaaatacagtcattaaaaacatatataagtaattggcttctttgctttcttgtgaaatatgctagccccacaacatgattcttactcattaactttagaagtgctgtttctaccgtattcacttcctagtggcattgcaggagatccgtttgcaatttgtgtgactgactcaagatttcatacaactcttgtttctgaaatgtcttctgatcactgagtcataagagtaacacttctcaagttgttattgttctgaaagtctttgaagggtctgggatacttggacaatattatttccatcggtacttttccatcctcctgtgtatggtattatttccagccaactttggaaaaatagcatttcaacagctttgcatatccacattgcacctgcttctggactataaatgattacgtataatttaaatttatagaaaatgttcacaggaaccagatcacagggcacatatgtgactactgattgcttctatttcttattttccaagtataaaaacatatttataatgaaaagcttatacttgctttatctccaaatcaacaaaaattaaacctctttgatattagccagatagactactctttcaactttgaccttaaaggacaataatgaatctcattaaaatcatatttccaaagtggctttcagaaagtctcctactcttacactatccccaggttcaacaagtttatttttggatgcacttaatgctttcgtttcttcttttcagattctgatttaatcacttagcttctgtggcataatcaagacaagttggatgaattgtctcctaactggattataatgaaagaagctctaactggtcttaacgtagtttcgatgtttggagtctttcacaaagagaaacaaaagcatgataagaatgtgctaagctaattcgaaagggaagcaagggtgtcacaattaaacaagggtgtccaattatattgttcccatacatcattccaccactccaataggacatgggcttatagagaacagagtcaagccttgtggttcctgttgtgcccagcacacacagcattgtgcttggtatatagtaggtgctcaataaacatttgaatataatttaatctaggctctcccagggagaaaatatagtttagggttcaaggtaaagaatctcaacatggccagcacagtggcttatgcctgtaatcccagcgctttaggaggccaaagcaagaggatcgcttgagtccaggagttcaagaccagcctgggcagcataatgagtccacatcttcacaaaaataaaaataaaaaaataaactggatgtggtggcgtgcatctgtagtcccaattaatcagattgcttgagcctaggaggtcaaagtttcagtaagcagtgatcatgccactgcactccagcctgggtgacagagtaagaccttggctcgaatcaaagcaaaacaaaacaaaacaaaaacctccaaaacatttaaacattagattctccagatatatgtatgttttgtatatcgatcattctatgccacaggaaatgttcaaccaggatctgggtaaccagattagtgtcacaaagaaggagtttgtagatcacctaggaagtagaactaagttatatctaagcaaccttacaaattgaaaatctatcagtctttgaaaacatatctgttctatgtttctcacagtcttattggtgatgggataatgaccagttggccatgatcttaacaggaaacgacaatgtaatatgctagcccttctaggtaacatatttaccctggcacagaatgccttaattccaaggtgtgactcactgtaatcctgagaattacagtaatttgggggtggaatattatggccaaaggcaatgagcacagaggaaacttctcactgcgaagctgagaatgaactgaaatgatcaaaaattgaatgcttgaagtcttttaataaattataggtagaaggtaaactcagctatttctggacagcaggaaagggtctaaacagaggaggtagcacagacgcagcaatggaatgtgaatgagtcatatttccacatcagtagggctatgaggagaccactctgagatgatatgacagatagtggctgcattcttcagccctaggaaaaatgaagattgcaggaattaggttaggaggtgaagactttcagggaggtagagtgggaaccagaggccagggagagtgttgtcaagtatgctgaccacacagtgaacacagaggatacagcttgatgctcctgaagtcattacaggcagggttaaattcccctcagtgacccactgacccccagacaccaggcatggggtcgaccagctctctccagttcttctccaccactacataagagaagaagccttgaaaatgccaccaagcttttgggctcagaatgaatcatgatggaagctactgcagccttgacactggaaggcatttcagttctgtcaactcttgcctcaaaggaatgttcatttccttttacacaagataaagcttctttgaggaggatttgtgtcaggtaaagaggaacactgaataaactgttgtggtggatgtcagtgtctattctgtgcctgaaattggaatttgggcttagaacttaaatacaggatgtgactcaatgaacagagaccagagttccagtacaagatataaagagactttgttttgaatcagttctagtatttctagaaattcttgttatatttgatggagtgaaatcggtaattctttgaaactctttaccttgtcagcttccatagtactctgctgtcctcattatccctttacttctctgagccttcacagaatccttcttatcttcccaacttacataaatgttgatgttccccaggaatccattctcagacctcactttctctatatgagctcatccatgctgcttcctccaatcatcaaccatattctgatgacatctacatctttacctccagttcagactttggatctttaaaatcatataattgcttctaccttctaggtctgactatctcacagataagcaaatgcaacatgatcaggatttatcttcacatccaagaggtccttctactacaagaccaccacatgccccatgaaagtcatactaaaaacttaggaggtgtcttgaattctcctttcccctcaaagcccatcatatctactctgtcaagtccttttcacattcccccaacactattcatggatgagtctcatcttctccatctctggaatcacctcgccttaaaggaaacatccaaatttatttttaaaatggaaatgtacccctatgcctgaatcacaggaaagcaataataataactgattaatatttctgcatcacttaaagaataacattcaaaatcacatgtcttttattatggaaatgcaaatcaaatcacattgagatattatgcaatacctcttaggaaagctgatatcaaaaattggaaagcatgaagtgttggcaaggatgcgtggatatgggaacatgagtgcatggctggttgaaatgtaaagtggtgcaactgctgaggaaaatggtatggtagggcctcaaacagttaaacgtagcattaccattgactcagcaattctacctttacgtgtgtgcccaaagaattaaaagcaaggattcagatatttgcacagcattgttcatagtagcattattcacaatagcccaaacgtggaaacaacgccaatgtccattgatggatgaagggataaacaaaatatggcataatatacatacaatggaatattatttagccttaaaaaggaatgaaattctgacatatgctatggcattgatgaaccttgaaaacattatgctaagtgaaataagccagacacaaaaggacgaatgttgttattagtttttctcagattacacatatttgaaatatcttagaagaagcaaattcatagaaatagaaggtaggatagtggtgataaggaactctgcggagagaagaatagagaatcagtgtttaatgggtagagcttcagtttgagatgataaaaatattctggggatggatagaagtgactgttgcacaacactgtgaatgtaattaatgccactgaactgaacacttaaaatggacaaaatgctagaaatatatatattatatatattataaaaatggagagacagagagagaggtagagagagcagatgagaaacaatgatactctatttttttcttctcacaattccttataactaatattggttatatatataaccactattctatatatcatggttatatataatatatatattatatcatataatatataaccatataatatatattatatataacacattatagatagcacagatgcagctatatataatatataatatattatattattataattaatataatatagtatattgtattaatataatataatatagtatattgtattaatataatataatatagtatattgtattaatataatataatatagtatattgtattaatataatataatatagtatattgcattaatataatataatatattaattatatatatttttatttctagatatatattatataatatgatatataaatatatacaatatacatttataaatatataaatatatataaatatatactatatataccatatataaaatatatacaatatatacaatatataaaatatatacaatatataaaaatatataaatatatacaatatatacaatataatatgtttaatatataaatatatataaatttttttttatatattaaaaaagagagaaagcttacggcatgtcaggtactatgcttaaaaaataaaagagtatataaatatatatatttatatatatctagaaagaaaaaaaacaaattgaaattacatgccatctcctacttcacacctcgggctccagcagctctatcgtcacctatgtaatcttcatttgcacgatacaccctgtccatatgaattgacagctgactgccactctaggacccttttctgcctccttacaaactggatgagggcttaggtcgctgacaatattccaaatatacccttttattttttaagcatggtacctggcatgctgtaagctttatttcttttctttttttcttttttcttttttttttttgagacggagtctagctctgtggcctatgctggaatgcagtggcccaatctcagcacactgcaagctctgcctcccgggttcacgccattctcctgcctcatcctgagtagctgggactacaggtgcccgccaccacgccctgctaattttttgtatttttagtagagatagggtttcaccgtgttagcctggatggtctcgatctcctgacctcgtgatctgcccgcctcggcctcccaaagtgctgggattacaggcgtgagacacctcacccagccaagctttcttttatttttatttttatttttttcggatggagtctcactcacacggttgcctaggctggagtgcagtggttcaatctcagctcactgcaacctccgccttctgggttcaagcaattctcctgcctcagcctccagtagctgggattaaaggtgtgagctaccatacccggttaacatgcagtaggctttcagcaaacactgagggaataagctcatgagaagcagctatttttacaaatgtaaaatattaaaattggaaggaatcttaaagtttagtctaaattcttaagaaaagtgctattttgacatggtagacaaaatggtgccttccagaggcctaatttccattttaaattaaatagcagcccccttttttcttttccttttgccaattgattctaccattttatgaactcatagaagggttagatctgaatcacacaattcattatgtcaagtgttttccaaacttcaagaaatcttatcacatcttcatagtgcttgctctacccatggactagctgttcaaatgttcaaataagttcatcttcatccaaagcaatactgtcaataaaatataaattattttatcttattttaagttccaggatacatgtgcaggatatgcaggtttgttacataggtaaatgtgtgccttagtggcttgctgcacctatcaacccatcacctgggtattaagtcccacatgcattagctatttatcctgatgctctcccttctcccaaccccctgacaggctctagtgtgtgttgttctcctcaatgtgtccatgtgttctcatcaatcagctctcacttataagtgagaacatgcagtgtttggttttctgttcctctgttagtttgctgcggataatggcttccaattccatccatgtccctgcaaataacatgatctcattcctttttatggcagcatagtattccatggtgtgtctgtaccacattttctttatccagtctatcatcgatgggcatttggcttgattccatgtctttgctatcgtcaatagtgctgcaaggaacatatgtgtgcatgtatctttataatagaatgatttatattcctttgggtatatacccagtaataggattgctgggccaaatcgtatttccagttctaggtctttgaagaatggccacactgtcttctatgatggttgaactaatttatatgtccaccaacagtgtaaaagtgttcctgtttctccacagtctcatcaacatctgttgcttcttgactttttaataatcgccactctgactggcatgagatggtatctcattgtggttttgatttgcatttctccaatgatcagtgcaaatcacagttttgatgtggtgtttatatatttttagtacattaaaataaataattaactagtacaataaaaactcacggatgtaccacctaatgtcattttcttgtactacatggtatgtaaatcatgctttgaaaaatcaatttgaatgcatgattgactactttcttgaattatcctccagggtcctgcatagacaactctgattcctcaacaagctttcacactctctaaaagcaactctctaaactctctcttttctttgttgtcatcgttttatgtttcttagctccttgacgtttgtcaagctctcaccgtattcaacaagtatctgttgaatagatatacttgctgcttctgagatggtatatattatcttcccttataaagtgaaagctatttcataaggttataaaattggaaggtgagatgtccatgagattgcaccttgcaaacattcaagtacaaggaggcaattgaatctgggtcgtggctcctgtactcctgaatgtttgcactaaggccacacctcccacagactctttcaaccaatgactgaacctgtagaggatgcgatggaaggcttctctctaggcaacatggaactcctctcatagccaactttggtttcagaactccctgaaagattgctgaacctattgacactgcacggtggtctagatcacttccaccaacttcccttccccctctccttcacttagggtcagacttgcatcataatttgattgattgttctcccactctttctctcctcatttttttggagggattttttcttaataaagtccctgtatatatagcgctgacatgcttcttgggatacttggactaacatagaaagtattagtgagaactacataaatgttagagatatttcaagctgaatttgtctatgagagtttggatagggttaattctgaattcagacagtgttgagttaaatttctgaattacttagttgtattagtttactagggttgccataacaaaataccacacatcgggtggcttaaaccacagaagtgtattttctcactcttctagcagctaaaaatctgagtttaataagtgtccccagggttgatttattctgagggcttcctccttggcttacagattatgatcttcaccctgtgtctacacattgtcttccctctgtgtgtatctctgtccatattttctattcttttttgttgttgttgttgttgagacggagtcttgctctgttgcccatgctggagtgcagtggcgtgatcttggctcaatgcaacctccacctccctggttcaagcaattcccctgtctcaacttcctgagtagctgggattacaggcgcatgccaccacgtccggctaatttttttgtatttttagtaaagacggggtttcaccacgttggctagactagtcttgaactcctaacctcaggtaatctgcctgactctgcctcgcaaagtgctgggattacaggcgtgagccaccgcgcccagccaataacctcatattaacggaactacctctttaaagaccccatcttcaaatacagacacattctgagttactgggagtgaggacttcaacatttgacttttagaggaacacaatttagcccatagcaccacctgaataactttgagccagtcacttgactttacagagccttagtctgtaaaataggggacaatatctaccatattattttgttcaaatcaaatacagtgacatatataatgccactggaacatataaggcaatcgtcattaaaaaaaatcctcccaatttactaaaatcattgccattactttattagaattaatttatataggggttctattattcgcagtatgtctcacagctatataaagtagcattatatgataaggttgaaaaggaagaggaaagaagtatacagtgtctgattgcatagcttcatgtttatgatatgacagttctatgattctgagcctggcatatttatttaagctatacaccagagttcagaaattgatagttaagaggcacatttggcctgaaaatgtctgtgattttccagagagtattttaaaaatcagaatagaaatgcctttaaataaagcatgcttctgctgttttccacagtttttcatatccctaacacatggtcacattatacaggtataatacttatctagcccttaaaagcttttaaatggacaatctttgaagcacagaccacaggttcagaatgtactgcttctatgtccttgactattctcaaaagaacatattttctaccatattatctaaattatctgagaaagacacaggtgctgctacattgttatcctctagggatgctcacgtttcttcaatatccacaaattcctcctacaatcatctaaggctgctccccattccaccagtaaatattaatcaacaaagtaacaaatagtgcgatgtgccaagcatctttagcgatatgcaccctcaacttcaaacagaaactatttgggatgatactccctcttctgcctgtagataggtaaacaccctctgcaccctagatttaccaaacttcatgacgtacccaccctaaaaggacacgatcttcagggtacacagagtttttctctagatgcttgacgatatcgccattcttcggctatatgagcttgctttttaaaaacaattacttcaggaatctggtatccagaagaaaatagggtagttttcaaactttcattgcattatttttcatgatcaagattataaggtaaattggaactattatcatgattcactcttccagatggttatgcaaagattgagtgaatgaatagagacaattttaaagaaatgaataaaataacttgtatggttaagtagcaaagccaaggagaagttgggaggaagagttcccaaattgccttcctgagactagacaatttgagtaggtcaagaatgagaatctctacagaaacttgctaagacttttaaatgcagtcatgctttgcttaaggatgaggatgcattctgagaaatgtgtccttaggggattctgttgttgtgtgaagatcacggagtgtacttccgcaaacctagaaggcataaccgactacacacctacacgatgtgatatggcttattgctcctaggctgcaaacctgtacagcatgttactgtattgaatactataggcaactgtgacacaattttaagtatttgtgtattttaacatacctgaacatagaagaagtacagtacaaatactatctaaaagtccaaaaataatacacctgtatagcacatttactgtgaatggagcttgtaggactggaagttgctttgagtgagtcattaagtgagtggtcagtgaatattactttataaacattgaagactttataataaacattgtacacagaggttaccctaaatttaacttaaaatttctttgttcaataataaattagcttacttgcaactttgttactttttaattttttaaaagcattttgactcttgtaataacacttagcttaaaacataaacacattgtatagttgtacaaaaatgttttctttctttatattcttattctataaaattttttctattaattattttactttaaaaagaaatttttgttaaaggctaagacacaaacacaacattagcctagacctatacatggccaggatcatcaatatcactgtcttccacctccacatcttgtcctgctggaaggtctttaggggcaataacacctgtggagctgtcgtattctatgatgacaatgccttcttctggaagacctcctgaagggcctccctgaggctattttacagttacctcccttttgaaaaaataagtagaaggtgtatgctctaaaataataatgaaaagtatagtatcgtatagtatagtatagtatagtatagtatagtatagtatagtatagtatagtacataaaccagtaataaagtcatgtattatcattagcaaatattatgtattgtgcataatggtgtgtgctatgctttgatcagactggcagcacagtaggtttttttacaccaacatcaccaaaaacactgagttatgatgttatggcggctacaatttcatatgtgatagtaatatttcagctccattaaaaccttgagaccaccattgtattttcagttcattgttgacccaagcattgttatgcagcaagtaagtgtgtatttaagctgcttaaattaatttcaattgctgttccaattttcttagtcattccacattttgttatgacactcctgaccatagaagaatgcagcaaaacctcacaattcataaaatcacatcagctgtgcacacagatgatgtacatttattctgtgtaagcatcttaaaaacaaactcaaacccattcttttttccattgcataacctttaagcacaatccaaacatttcatttgatgctattaaaaagatctgccgatgcaaaaccatattatagccaggggtggcgggttaatacttcaagtattttcaagataacttttactgttttggctatatacaaggtggtgcctttgcactgattttgtcaccccttagcatgagatgaaaatccacaggaatttaaatctagaattagaacatatgagcaagaaaatttgatttctttctgatgcatgccagaaatagtatattaacaataatacaataaaggaaattcaaaaagtattcatctaatccttactaaagttattatcaatgagttctaaactttattttgtcctttaagaatcacaaattatttgtttcaaatgatcctaatcatcatctaatgtgtcttatactgctatcctataagtttttttgtttttgtatttgtttttgttctttggagatggagtcttgctttttcgcccagtctggagtgcagtggtgtgatctcggctcactgcaacctccacctcccagattcaagcaattccgcctcagcctcctgagtacctgggattacaggcacacaccaccatgcctggctaatttttgtatttttagtagagacagggtttcaccatgttggtcaggctggtctcgaagtcttgactttaggtgatccaccctccttggcctcccaaagtgctgggataagtttttatcccataattaccccataaaatttgaataagaaaatgaatgcctcaggaaaggcaatataaaacaatgaagacattaactagtagtcattataaatatagttaaagacctaaatgaaatcatgcttatagaaatagagaaagccatgacaacaacgtttcagcaaagagagaatatcaataaagatatagacattattttaaaaagaaccatctggaaatgcttgaattgaaaaatataataaccaaaataaaaaattcactagcagaaagtgaaaagacaacccacaaaatggggaaaaatttttgtaaatcatttatctgacataggacttttatccaaaatatataaagaatttctacagcttaataatcaaaagaaagatcactcaattgaaaaattaagaaaggatctgaatataaatttcttccaaaagtatgcaaatgaccaatatgcacctaaaaagatgctcaacatatttaaaccattaggaaaatgaaaatcaaactcacaatgagggccaagcacagtggctcatacctgtgatcctagtgctttgggaggcccaggcaggaggattacttgaggccaggaatttgagaccctatctctacaaaaaaattaaaaagttaaccaggcatggtggtgcacgcctgtaggtctagctactcaggaggttaaggtaggaggatcacttgaacccaggagtttgaggttgcagtgagttatgatcctgccactgcactccagcctgggcaaccgagtgagactctgtctgaaaaaaaacgaaaaaagaaaaatcacaatgagttagcacttcacactcagtaggatgaccataatgagaagcacagaagaacaagtactgggaagcatgcaaagaaattggaaccctcatacactgtgggtgagaagggaaacggctttggaaaaccttctggtaattcccagttaaacaaagagttacccattatctagaaagtaagtgattttatatcatagtttctgctgcacaattttaattcatttattttactgacaaaatttaacaaatttattttagtgataaaattagacaacttaaaataatttgaaaccaagtaaagtaatgctttttcccttgcgacgtcattagctagtacaatgaatttttgagtatcaatcagtagtagccaccactcttgtcaaccagagtcctctctttagccaattctctagttcaaggcaattaatgtttttgaggttgacatgggagtcaggcatgactctgtggttccttccaaaccatcagtgaaatgtttaattatatttagtaccatgttttatgaagtcattttattcttggaattttggcaaaccttgaatcgtacttatagtcattccccaacaactaaaatatctgatttagtcttccagatattagagtttacataaatatttttaaagcttacattttcatatgtatatatttccaatgaaacccctatatgtttgaaccgtttctaaaattgtcattaaacacccagcaataagtctattattctctgtactaatttgctatacttaggctgtgtagaaagttttctttaatggtctcttcaaaatttcaactccgcccgctgacatttagtgaatgtcaagatgcttaatacagggctgtgctttctgcttttttcaatagatcctattgttattgacttatcctgatgagaaaataattctatctcaaatcttagaaaatgtatctttggatcaagtaagtatgttagtttcttaaagtgtccaacccttcatcaaatttttttcattgattaattttacaaattttaagaggaaagggagaagtgatcatcttattttatgtaatatgtttatttgtttaaatatgtagagcttattgaactacattaaaatagaatgaggctgtgagaccacatagaacctgagaggagatttaccagtaggtcaaagaagcttttactttaagaatatcaataatttcccaaggcaagaaaaatgtaagattttacatgctaaagtcatatagtcagcatcatttaaactgccaactgtcacaatttatgatttgtcatttagggtttgtctgacccccatacaggtgaggtaggggaggaagaagagagaaggtaggtccagctcagatgcctgctcaggtggtcagaactcaggagatgaaccatactgagtagctggaagagttaagaaacctgtgtaaggatgggccaattgtcaaagcagttggagccaaattctattcttagtccaagtgtttagcaagtgacttagagagacaaaactgctgccagaagtcaagtgaacaccattatggtgcatgtagtgaaaacaactgagagagagagagagagagagagagagagagagagagagagaactgcaaaaaggtcactcattgatactgttttttttttttttttttttttttttttgagacggagtctcactctgttgcccaggctagagtgcagtggtgcgatttcgcctcactgccagctctgcctcccgggttcacgccattctcctgcctcagcctcctgagtagctgggactacaggcacccaccaccacgcccggctaatttttttgtatttttagaagagatggggtttcaccgtgttagccaggatggtctcgatctcctgaccaggctatctgcctgccttggcctccctaaagtgctgggattacaggcgtgagccactgcacccggcctgatactggtttttaaaatttattttaatgatttaataactatttactgaattctttcagtatgccaggcctagattaggcttcagtgatataaacgtaaacaaaactggcacagtctttgacatcatggaacaccgattctaagagaaagagagaaatattagtctaatggccctgaaaataaaaacaagttacaatcatgaagagtgtaataaaggacaaagttgctgtgataacccataatgaggcaacttgacttctcagggtcccttgccttctggtttctggtcagatttgaccaatgggaggtaccagtaccagaggagacagcagagactgagatctagatattgtttcctctgcctcatgccaattatggctttctagttctcagagaagcctgtacatctccagcagctctggccatattctctttatggttccagctctcgttattatagctcttgttattgttagtatctggatggcttgagattaaagggtccatgggatgtcctgctgctggcagtggctcacacctgtaatcccagcactttgggaggccaagttagtttgctcggttgaacccaggagtttgagaccagctggggcaacaaggtgaaaccccttctcaacaaaaaatataaaaattagccaggtgtggtggcatgtgcctgtgatcccaactactcaggaggctgaggtgggaggattgtttgagcccaggaggcagaggttgcaatgagctgagatcgtgccactgcactccagcctggggggacagagcaagatactgtctcaaaaaataaaaataaataaaaataaaataaaaaaggatccatggtaacatcttcattaatttctttttagaatctgattgggatatagccttctttttcctgcaaggacaatggctgagagtcagttaggtgaaaactgggtaaaggcagactaagaatatgaaacagcatctgaggtggaggtgacaatggccagtcatagtcacgtgagtgtgtctggaacatggaacacaaccagtcttgcatgaggcaggagacctaggcaagagttggatgatgcaaacctatgggtcatttgggggttttgtctctattataaaagcatttctgaaggttttcagtcagacgagaactttatcaggtttcaattttcaaaagattattctgactgtgttgagaaaaacatattggggaatatcaacagtgggtgtggatagatcagtttcttaagagctttttgaacagtttgacatagagctgatgattaattagactaagatgtcggtaatggaggtagactaaaagaaattgaaaggtttaatcggggtcaacaaagtatggcctgtgggttggctgtcattgtaaataaagttttattggcacatggccacacgtatttattatggattgtctatggctacaacagcagagtagagtggttggaacagaagctgtgcggcccgtgaagtcttaaatacttactctcttgggctttaagaaaaacttcgtcacccctgggttaaatcaagagcatttggcattagattagatacggggctgagggaaaaaaagggaggcaggagagtcagggacgaaggagacgaggccacagaagctcttctttgacagtgataatcttattttaggtgcataattttgggatttataatatacagatatataatgtatgttatatatattataaatatatatattatagatacaaaatatgaaaagatatgtaatcttcttgtctttgtcaccaaatcatcccattgctgaataagacttcttctattgttcttttgttttaattgcaaaagtctagttttccctttgaagaaaagaagtagagaaaacattaattcacaagggaaaggaccgtttgtctaattttgttagaaggtctcagggctcagttctcttctcttatttatgtatattcactcttctttgttttttaaaaaaatcttatctaacctcatggctctaaataatttaacatgatgacaattcacagtttatatttctagtctgaacctctaaaattccagacaaataattaattaccttttcaacatcgccacttcgatttctaatagacatctcacaatcactgtgtccttaactgaattcttgacttccccttaagcagatctactcacagttttcccatttcagttgatgaaagtgccatcctttcagtcattcaggccaataccactgggaccctccattaggaactatgttgcctctaccttcagaacatatccagaacctcaccatctctcccctcccccccaattgtcactgtcctgatcagagatgtcatctttcctaggctgaatttctgtaatagcttcctagcacgtctacttgcttctatccttggcctacccactgtagtctattttcaaagaagtagagtgaaccttttaaaatagaagtcagatcttgtcacctctctactcaaaactctccaacagcctctgatttttacttgctcagacaaagtacttaaaactgcacacatgacctcacataatctggcttccatattcctctggcttccaatatgttttattcactcctctaaatcatagagtctccttgaattaacatgttcctgatccaatgtactgtagtaaaggagtgaaaagtaaacatgattcccagaggcagttagtgagatggttgcaggtaaccattgcctcccacactctcttccttccttccatcctggcataggttatttagcaaaatacttagtaccttctaatatgtgttacatgactgctagatgccagtgataggaaaatccatacaacataggaacacacaatctggtggggaaagatgatatggaaaccaaccaatgcaagacaatgcaaaaagtgcaggcatagaatgatgggctgtaatttttaaaaactcaccatgtctaagttgggaaggatagagattctatatgatggatgcaagatcattccaaccaatgtagtttggaagaaacccaaagcattctaaattatctagtgaacttcatgttgctctacctaaagtatttccatagtaaccaggcctgtgctcttgtgtggagcatgagtggctaaccactgaattatattccttttgtcacagtctaagagcaatataaattcctctttttttcaaaatgcttcccaacttgagacacaaacattctaccaagaatagatttgacttaattatctatacgtttaaaatgtaaatgcagcctttctaagagaagcctacatttgttaaatcaatctatgagatcaccttctttctaagatgagggtaacttcaatattgaagtgaagacagtatagagacactaagaaatctacccaaggacacacagctgatcaggggctctgacttaatttttttcccaaacattaggtttcctgagtgcaaagttgttatattcgttcctacctcataagattgctctgagcagtagaagtgataatatctgaaacatgtaggacactttctatgatgtactaacagtgcagtaattgttagtttctccaatgtcccacagccaacctatgctactggctgcaaattctaagttatggactattaaatgatctggtcaaaactggatatggataaaaatgcactttagaattacttttgggaagtagaggttgccaattaggtgggtggaaatgctttctgtcctgtaaagtccaagagttgtctatcaccaacgacaccattggagggaagctgttgagtgcactacctgccatctgggcctctgttgttggacactacttgactctttaaaagaggttgctgtcagcatcatgtctatttgcactggttgttgagcatcattatggaaggtgagtggcccatgttgacctttatgctcctacaccaacttgagagcctttaactgcatagaggcctttgacttaatgtaataaaataatgactctttccatttcaatgtttccattggtgttttacttgaatccctactatacaaaaaaccttagtctcaatagtttgaacagtttcttctatgtccaaaacactcaatattgagttctcttgataaaaacaaaacttggagttatttaaaaaaatagttcagttggagactccctttgctatctaaggcaggggtccccaacccttcggtcatggactggaacctgtcagtggcctgttacaaactgggctacacagtaagaggtgagtagcaggcgagcaagcaaagtttcttctgtatttacagcagctccccatggcttgcattactgcctgagctctgcctcctgtcagataagcagcaccattagattctcttaggagcgtgaaccctattgtgaactgtgcatgcaagggatctcggttgtgtgctccttatgagaatctaatgcctgatgatctgtcaccatctcccattaccctcagatgggactatctagtggcaagaaaacaagctcatggctcctactcattctatattatgtgagttgtataattatttcattatatattactatgtaataatagcagaaataaagtgcacaataaatgtaatgtgcttgaatcatcccaaaaccatccgctgctccccacgtccatggaaaaagtgccttcatgaaattggtctctggtgccaaaaaatgttggggaccactgatctaaggtgtttaacaaactgtttcttacttttaatcaaaccataccacactgattgacttcagaaatgctttgtttaactagaagtgttcaggacttacgcatgttgcttttatcatcatcatcattataacttataacactaataataacaataaattaccagactttgagaaaaatctcagaagctcaatgaagtgtatagttcataatcagtactaaattgataggcttgtggtttagaatttgtgtagcggaacgaggataaatcagacttcagtatgatttgtgtatttgtttactgtagcagaaatatgatgtcctgaccatgtccccttgacccactctggaagccatgaaagatagtctcattcagagctacagctgtccatggctctgcttgagggtgttccccaggcccagagaaacaccttcaaaggagagagcatggcatagaagcaaccctcatccaacaaaagataggaattgtccatttcagggtcaggttccatcttccatctggtctccaagagggtcctcaaaagactacgcctcccatgactatacaaccttccttagctttcctctcttccttgttccccattcccacttcttcacatggctttctggaattacttcccaagttccttgcacctacgtgcttgtcatagagtctggcatgccttaatgaaacactcgttaattttttatttgagatccattgaatcctcactctgtgccagacatctttcatttatgaaatagtagcttctatttttgtacccatttttgtgataaattaatgtttagagagatgttaaataatttacaaatcacagtgagtggcaaaacctagtcaatttccattcttcagttgcttctattgtttgattgctatcttttacctttactccatgaattcagattggtaaaacaaacaagagactaaatgctgttatactgtgacattctgtaaaattcaaatctctgggtgaattttgatctaagggatatagaggtgtgtcttttttgttgttacacatgcaaagaaggcttctctccactgtacaatatccccttggcttggctgtgagctcatctgctctcatttttgacttcagtttcctcaaatggaaaatgaaatgccttgggctaaatgaattttaggatccattgaaaagctaacttcatacaaattcgagttatgtagtctggtccctccggccaactctacatcgctagctttttgttttatgctgaattctcttgataacaacttctaaagcaaagcttttctataaaatgccagatagaaaatattttaggaattttgagctgtaaggtatctgttgtaatttctcaattctgcaatgtaacacaaaagacaatatgtaaatgaatgagtgtggctgtgtcccaatgaaattatttatgtcaacaagcagcaaagccactagacgtgctcaatgttgcacacagagaacagcctcgaagggcctcacaccaagacatggcagatgaggaatgacaggaaaatttcaaacattgcttgtatcctctgtgtaactgtcctcctggaaactttaaagatatcgctcactcacatagcttctcaaagaaacaaaggataaagaaagcttttctatttctttcttacatgagcccggatggcttctacttgacatggactgttttgtgttgtgtttgcgctgggcttagaggctgagaagagtcaatacccaatgggggtgttgtctggagagctggggaatatataaatattgcatttggaatgtactttcctcttgaacaatcaacctttctgcacaagtttgcttgctaagggtctgttattggcatttttcttataacccctctaataccaagccttttcaaagaacatatgactcagagcaaacattcttttgaggttgaatctggcattcttgatgttattcaaggaatatatttctttgtataaacttttcatagaaaacttcctgaacctgttttagagagcccagaaagtcctagaaaaaaaattgctgcctcatgcttaagcttctagtgggttttgtgaactgagaatgcgtaaacatggtcaaacattatttctgatcccgtttgtactgaaaatctctcctgggctggtgatttgtaattaatgatagttcaggaaaccttgacaactatcttagagttggggaaaagtgatacaggctaagcaacgagctcgttgtcattacatgtaatcaagcagaaattgaacagccattcaccaatgatgctgttcagagatttcacatcaggtgagactttaagaaaatagactctgcagagactcacctccctacctgtgagggagaagcaagggaaggagtggaacaaggtctaaggcagattctatactctcccttttctcctctctcctctttgaactggaaaaactcaggtttacttttttagatattagacagttaggaggctttcttaggaagaaagtgttctactactactaataacaaaatgaatgaatgaataaataaataaataaaatttaaaccactggacaactgagatcttgaattatgttaatcttaagattttaaattttctacaagtaggctttgacccattccacataagaactcatccctgtctatcttcctcttagtatctctctgatctccacaaaacaagtatgaactctttttatcctagatacatttaacagctacatttgatagaagagtagaaaattcttcataggttttccatttacaaggaatagccatcaggtttagaattttgaccatcattaataagtaaactcttcaaaagtcaagcagggctatgttttttgagaactcagccctttagggataaaaggaaacctttagtaaatatccatcggtctattgcatcttggccctaggggcatgcatactcttcgtgttatgtcctcacataacttttatagctgattctcttaaagaaggatagagtcagaggagacagtgaaaaccatgaaagtatgaacatggaattcagaaaaggtgacaatattagtatcaaacatatgtcaggtatggtaggtacctgataaaaatttactgaatgaatgattgaggccatgattatagacactctctatataaagtcttctataaaaagaagaattttgaagcaactatcatttaatttaaatattgggccaatatgtattttaatggtaatgttggaaaactatttccagcaacaaactttatagtaataagcaagcattctgcttatatgaaaatcacaaacagtggaagatattgacttgtacttattgtgcaggttctgaagaaaaccgcatatggtctctctggcaaaagctaatgaatttatgttaaaaatatttttctgcgtgtattgcaagtgttatatacacataattacatgataaatataattctatttgattttccaagtaattaatattttaaatatttgcaaaaagggctatagcacacacaaaaaagagagagacattgaaaaatctgttttaagtataaaacctaagcagttggcagaggagaaaagaaagaaattttttacatctcattattaggattcagtgcacacttatagaagagttccttccccctaaaccctagaattctagcagagaacagagccaaagtgaattatatataaccctgaagcttcatcaagagaatcattggtatttgtttacagatcagtattgaaaacaaatcagcctggagggtttagctgtatggaaggatgtagtttgcttcttaaataacccaagctgtgttgaaaatgttctttctggcctccttatgttctttctgttttgtttctcctttcaaatgcagagtgaatatgattggaatggtctttagcttcagccaagatctctaatgccctatgactggggcacccttgtcttttcccctggtcttccttagcatggtagcctgtgatacttcccaaagttgagttctgggtgactggggacagcctgagaaatgatggtcgaatgatggttgaagtgatggtttctgtcagtcaccaatgaaggggcccattaattttcaaggcttagtgtgagttccatctgttatcctaattgtttgtggagattacatgccagggaaaagagttactgaattaattaaaagtaaatgtcgcttcctaaaactcagcccggtaaacacagcttggggaaatatttccttttgcttgaatgacagctcttggagttaggtaacgtggtgctttcagacatggtttacacctgcagaaacgtacattgctggacagctgtcctgccccctagggtatggatcactgacagttctttcttactgtcaattttgcagagcccagaggcagatgcctacgtgacagcactttaccatccagcatgattgataagacaacccaataaggatccaaagcaatttccttctcttatccttgcctctcaactacatttgcttttaatggacatgagtccaggctggcagttgtggaaagattctgggatgcaatgttttgggggagagcaccaagcttcatttctgatctaaattgctagttggttcttattttaatcttaaatacactgaagaacagttgcctttgatgattttgtcagaactgctagtttctaacgcatctttggcattgcctgcaatttccaaggctaattttaatatatatgaaaaatattttaggattagaatgtgacatcctactaatcattcaaatgaaaaagtagagtggttgaagtcaccattgttctctgtagcaacaataacaagcaattgttatctttactagctttgtcctaccactcctgtgtggctctgagatttacagcaatctacaaatacataacaatcttcgtttcacaagttatggctcatgtttcatattcctttgggcctagcaaattttcattgctggtgaggtctagccattggacaaccaaaaattatgccatttttgaccttgagtcttcattaactaggagacaagtatatatgacatagtggagactgtttaggaaaagaaaggaaaggaaattcatatttattgaggctttataatgtacgattgtagtgggtactgttggtgctctgctcatattccctgagattcctgtttacattttctagtgccttttgctgccttgctaagctcttccttcatctaatggcctgcatctgtggctcagcttgggagcaaggatggcccttgcattgatggaacccctgtgtccaagaggcagagagtgggacgtgcttgagagtttacagcttcataatatcttctagccagattgattagttgagggaggaagacagcctagctctcttgccttaagtcacaacaaaatccagagcataattggcacaagacatttcctttctgcaggatcactctgagactgggactgtgcctgaaattatatccttgcttgacttttctccacactctgttactcctttctcctgggaacactttctcaataaatcacttgctccataatctttgccacagagtctgtttggaacatacttatgctatgccttctacatatactgtattacatatgctatgcctttatgaatactgtatatttaatctgcacaaaaattctgctaggaaattcatgatcagagagatcaattaacctgtccaatatcatagaaggattaggtggacttgaactcaagtcttatcccttaatttattacattttatgctaagcacaggcaagggatatggaatacgtagatccaatttggggaataaaggcatttggagatagattgctcctgcaaactagacctgaataccaacttcttacacaaaagacatcatttgagaaggaaaagataagtgcaggtttattttgctgaaaatatatcaagcataaagagtactctattttggcactggaagcaaatgagtcttaaaaactgctatgtgattagctgggcatgggggtgtgtgcctgtagtcccagctacttgggaggctgaggcagtacaattgcttgaattggggaggcggaggttgcagtgagccgagatggcaccactgcactccagcctggggacagagcgagactccgtctcaaaaaacaaacaaacaaacaaacctgctatatgtcttgtttcatgacggctttttaaaataaagaatactcatgcaatgcataatgatgctttggtcaacaacagaccacatgtatgatgatggtcccataagattataattaaactaaaaatttataccaccttagtgacattgtagacctttctgtgggacaaaatgtggaggtggaagatctgatgatcttggccctggggtaggccttggctaatgtgtgtgtttgtgtctttgttttaacaaaactctttaaaagtaaaaataaagaagtaaaatgaaaaaaaaatacaataagaatatgaagaaaggaaatatttttgtacagctgtacaatgtatgtgttttaagctaagtgtggttattatgaaagagtcaaaagtttaaacaataattgtttataaagtaaaacaattataattagctaacgttaatttattactgaagaaaaaatattcttataaatttaatgtcgccaaaatgtacagtgtgtataaagtctacaggagtttacagtaatgttctgggcctaaactttcactcaccactcccctggctcacccaaaacaacttccagtcctgcaagctccactcatagtaagtgccctgcataggtctaccatttcttatcttttataccacatttttactataccttttctctgtttagatacacaaatacttaccactgtgttacaattgcctgcgatactcatacaataggttgtctatttccagtatagcaatgggctatatcatatagcctaagtgtgtagtaggctacaccctctaggtttgtgtaagtatgctctatgatgttcacacaatgacgaaattatgtaatgatgcatttcttataacgtattctcattattaagtgagacataactgtacttgcgttggaagtggctagatccagtatcacacgcggtctttgctagaaacaaatgaatgtttgtaaacagtaaatcaatcaaatcatcctttgccattcacaaaggaagttaagaagcttggcagaaaaaggtctcgcaaaccctcaacttggatttttttttttacagcaaattagtttaaatcaatgacctcaaatgaagagaattattgtcagcatttagcttgatctttctcattaatgacttccactgtgtttctcccataattagttttataaactagcccaaaaaacaaacatacaaaatgctgggggtttttttttgtttgtttttgtttttgtttttcctttgagacggagtctcgctctgtcgcccaggctggagtgcagtggagcagctcactgcaacctctacctcccttgttcaagtgattctcctgcctcagcctcccgagtagctgggattacaggcatgtgccaccacgcccagctaacttttttatttttagtagagaagggttttcaccacgttggccagatggtctcgatctcctgaccttgtgatccacccgcctcagcctcctaaagtgctgggattacaggcgtgagccaccatgcccggccaaaaatgctttctgtaacttccacaatgaaatattattctcagattatcactaaatttaacccaaagattccattatctcttgctttttttattattattacctttggtgcttggggagttcagagatgccacagatgcaggacagtttatgactcatagcagaagcagtaccaacagtctcatgaggctgtgactggtagcctggcctccttctcccactttcctggagcatccaggtcatacacacagatacttcccagttcccctttggttgaaggagggcttcgaatcccttcactaacatccagcaacagcaatgtaggcaaacaaaagtcctaaggtctgagttctagcaagcatttggaggaatgacttacaaggaattaaagtctcagaaaataggataagttataaatattggctttccatatgtgcattcaactagcacacattaaattccaagtattttacaaatatctacgttatgaggaaagatattttaatccatttcatagaagtctgaggttgagagggattgttaatttgctcactccagtaagtgaaagagttgagattcccagctggaatctccaatctaaactcagtgttccagctccttcacagtgttctgttgggctcagaggtccacagtgaaaaaagcatcctgtgaaggctggcatccacatcattctcatgtttttgagagttcactgcaggcagttttgtcaacggcaccagattgagagtgaagctagaagaggcagacgtgggatagctatatccttggcaataagcatcaagaggctgggcgcggtggctcatgcctgtaatcccagcactttgggaggctgaggcaggtggattatctgaggtcaggagtttgagaccagtctggccaacatggtgaaaccctgtctctactaaaaatacaaaaaaattagctggacatggtggtgtgcacctgtaatcccagctactcaggaggctgaggcaggagaattgcttgaaccagggaacaagggaggtggaggttgtagtgagctgagatcatgccactgcactccagcctgggcgatggagcaagactccgtctcaaaaaagaaaaaaaaaaaaaaggaataagcatcaagagagagtagccagaaatatcaaaagccccagatagccttaatttaagggctctagagttctcctctgcaagaaacccttattctactttatagtactctatttattaaattcattcttatagggtgactaaaatgtgccagatccccaccctcaaagcacttaaaatctaatgagagagacaaacaaactggaaaatttccagttgttataactgttactaatgaaataaacagaatgtgacaatgcagagtgacattcaattgctcttacttgtttatgtaaccactttcactaacagaccatatgagctcctgggagtgatcttttgttttttattcttctttatatttctaatgtctagctaattttagatcctcaataaatgctcatttaattaattaatagatgagtgaacatataaagcagcctctcaatgatgtactctatattcatctgttctcatactgctataaagaactgcctgagactggataatttattaagaaaagagatttaattgactcacagttcctcatggctggggaggcctcaggaaacttacaatcaaggtggaaggggaagagctatgtcttacatggcggcaggtgagagagtgcgtgtgtgaaggaggaactgtcagacacttataaaccatcagatctcatgagaactcactcaccatctcaagaacagcatgtgggatgctgcccccatgatccaatcacctcctaccaggtctctccctggacatatggtacaattcaagatgagattcgggtggggaaacaaagcctaaccatatcatgctccaaagaattgctagaacagaaataagtagctcaaaggaaagcctatttttttccttttgaaactgaagctaaaatgctttcagactttctctctttgatacatttggtgttcccataatgagagacagactatttactctgacatattttctactagtggccacttctcatgaacatcttaaggtgaacaaggttacagctggctattttccagaaataattaaggataattaaaaagaaatatttaatctgaggcttcagaaaattggatttgggtttctcaattggtgttagaagtcaagtttactatcaaaatatttttaaagtgcattttgttttttaccactaaattttctgagttgtctcaaacctaaaattgaaacagtaccttcataataaaaccttccttctttactgcaatgctactttaggcaaagtatatataaaaatgagaatttaaagaaacctatatgatctgtactttaactcagccttgactaaatcacaagtttcaagtaactaaggactcatgaatgggatcccaggcacccaaaacacaaaaacatgatgaaaagtaagaagacgaaaatgactagagtggctttaaaatggcttatccaaaatataagaagcgtttttttttctaagtggaattttttttacgctctcacttattacattattttggttaactgtcttcatgtgataagtgcatttttttgacttaatgaaacagagtaaaaaaaaaaaaacataaaaattaccatgtaagaccagacccatcaatgccttatatacttttattggtgcagtttgtcttctatagcctttaacccccaacatccctttcacatctaccctgcagtttcctagtaaggatttctgggaatgtatatgaatatctgcagatattaagtagtgatgacacatataatagtgaggctttcagatgacatatatgagcatgtgacatgtggtagagatacagttggctctcagtgaatgatatatatttcacacacacacacacacacacacacacacacacacgcacatgaaaatagtttcattggggcttctctattggcctgtgtatttcatgaataactggcctgtcaataataaaaactggcacaagtattgtgtgcactctatctgctttccttgctcaataaagtgtgctattagaggtttctcaggcagtttcaaacttaaagatttaccttcacatttcaaaaaagtagccacgtaaaacaattccaaattaaagtaaatgtgtttggattatggcacaagcaagataaaagaaggatcttctcaaataagttactgtttgtacctcaaaatccccacatctgggaaagacacaaataaaatttcactttctttgttctgtttgttgctgagcacaatttaattgcaatcagatagaaactcatcctaatgacatgcaaagaagctaaaaatgatctttcggtgatgacaagaaactaaactttttcgtttggatagtcactagaagaaaaacaattttggagaaatcatgagggcataagcaggcagcataccatgcatgtctgggaggcaaatattatttatctaaatgaaacacattgtgggtttggcggccaacagcttccatgataaaatcagtgtgaagcagatgtgtgtctcagtagaaccgtgtttgatgttagccctgccacttgctgctgtgatcttatctataaaaataaagacaaaatacctaactttcttgtacaaggatgctgcaaggattggattaggtgacccaggcatgtgcaagcagccagcacaatgcttccatcagggcttgctcagtcaatagcattctgtcatctctggattgatctaggtctcagttttcacatctgtgagatgggagccgccttaagggtgttgggcatttccctatgattcacaaaggaaggtcatccagcaatcctagtactgggtatatatccaaagtaaatgaaatcaataggttgaaaatacactcctatgttaattgcagcactactcacaatagctaagatatggaatcaacctaagtgtctatcaacagatgaatgaataaataaaatttggtctatatacacaatgaaatattatttgaccattaaaaaattaaagttctgtcatttgtgacaacatggataagcctggggagcattaggttaagtgaaataagtcagacacagaaagacaaatgtatgatctcttgcatatggaatctaaaaagttgctttcatagaagtagagagcagaagaataataattaccagaagatatgaagcagagggggaggggagatagtaggcacttggtcaatggctacgaagctacaatttgataggagcaataagttctggtcgtctattgcagtgtagggtgattagagttaacaataatgcattgcatatttaaagctagctaggagagacgtttaggaatgatctcatcacgaagaaatgatatatgataaatgccgatcactctgatttgatcgtgcactacttacacgttttgaaacatcatgttgtaccccgtaagtatgtacaattattatgtgtcaatcgtgaataagcaaaaggaaggtgagaatgtgtctccattatgcgataattttctttgggggaaaaaaaggataataaacattatgcaaccagacagggcagaggtagatttcttttaaaggggagcaatcagagttctaaatgacatgaacatattttaaccatgaagaatttactgtctagtcaaattgatcagttattgccaagtgctttgaaggctctattatctttagactacctggaggaacattccatgtatttccctattctgttacattgtgcagcttatttagcaaacagttacgggaggtgtttttaagcatcaggaggaaaccaggttgtcaagaaagaaagttctcttgacctgtgacaacaaggcagtctctgtcatcctcagatttatgtaatgtgtaaagagattctcatttaaataattccattgaaataaaataatacaaatggatcatgacactgatttatgctttttaaggttatgttttatttgtatttgttttttctgtttgtttgtttgtttgagacggagtctcactctgtcatccaggctggagtgcattggtgcgatctcaacacactgcaacatctgcctcccgggttcaagcaattctcccacctcagcctccctagtagctgggactacaggagtgcaccaccatgcccagctaattttttttttttttgtatttttagtaaaggtgggattttgccatgttggccaggctggtctcaaactcctgacctcaagtgatccacccgccttggcctctcaaagtgctgggatgacagccgtgagccactgcacccagccctgtatttgttttttagatatgtgatagaagaagaaaatagaagcaatgtttttggatgctaatatatgccagaaactgctattttttcagataaataataatatcagaaataaccagttatgtatcaaatagtatgccaaatgctttgcatccattatgtcacttaatcctcatatgatgtgaggaagctgaagcatgaaagaggaaacttgctgaaaagaatcagaacctcaaatctattgaacactgaagctactgtatgtcaccatggtcctatagtatccaaatcgcctttaaaaacttacagcaaaatgccattggtttccattgggtggattaggaatacaatgggattacagcccatgtcataattctggagtagaaattctactccagggtcctggaggctttgacttatcaaacatctgaacattttaggattggccccactcactgctggacaatctgaagagaagccctagcagctcctggaaggggcagtttccagctttgtatccattctgctcactctcatctccactaccatcttctccacatcactgttgtaggatgcatatttgaattctccagtagattgtcctatggactctgttttctcaccaataattacctcctgaacaggctgcacctgaatcctatccctttcccccacaattttttttttcttttgagatggagtctcactctgtcacccagactggagtgcaatggcgtgatcttggctcactgcaacctccacctccagggttcaggtgattctcctacttcagcctcccaagtagctgggactagaggcacctgccaccatgcccggctaatttttgtatttttagtagagacagggtttcaccatgttggccaggatggtctcgatctcttgacctcatgatccacccgccttggcctcccaaagttctgggattacaggcatgagccaccatgcccagcccgtttcccctgttgaacagaatgcagactgactccacatgcttccagagcaagaagtccaaccacctaccctaccagtatttacttccacatcaacttgccaggctgcagccagacccctcctgggactctttctctgccttctcattcccatctttctctactgtctaagccactctgatcaatctgtgaatttccatgtccaggggaatcctcttccacccttcaacactcagggatcttggatatgtagctagagattaggttgggggccacctgctcctttcaccaactaggaagcacctttaaaatatcagaattattatcacaatgcatgcttctttggtttgtagtaaggataaatgagatcttacatatggaagagacaagtgaagggatacaagaatgtaagacatcctcatgattcattaagagatgcatgcattctccagctatggggacgcataatttttgcttttatgtttactttgggaatagtactttattttacttcatgctcctctatgaacaagagatctatagtgtgtcctacagggaaatttaattccctcttttattcttgcaaactagtaagttacaggtttagccataaagaagcaagcaggcatctctgttttcaatgctctctaaaaccaaacaatcctctggggattttggtaaaatgcagattaattcagtaagtctggggtgggacctaatattctgcatttctaacaggctcccagatgatgctaattttgctggtgcatggaccacactttgagaagcaaaaccctagaacattacaagaaattcctaatctccgtgatctgctttgtttcaaaatatttcctttcttccatctttcattagcttttacttatttactcaagccttattcccaagcaaaacaggtctcacccaattagaaagagtcaaagacaaaattgctgacaactctcttggttttctatgctactttcctcttgatcccactgaacgtagatcgtgtagaaatttagatgaaggacacatttaagacctactcttagcacggctgatacaaagtcatagctctccagtacatattttatttattaggaaaattgaatcatggaaaaataaacagagaaacctgaagaggaaaaatatgaatacagcattaaaaacataatttgcctttcaaatagaaataataccagccatttattaagtacttttcttgtgccaggcatctcatttcatgaataatgaaatattctggaaatgaattattatctgagaaatttgataaactcagaccgatcctgccttgttttgtgctatgagacattaatgggattttttgcaactgtgaaatggtaggtatttaaataggagaatgggaaattttaatttgatacggttggcaaggtgtttgatgaggctgtcacaatgacaacaaaatttaaatgcatttattgggattacctgtgctgactgaaatgcaaaagacagaaaaggattcattcacactgacttattttgaatgtgatgcaaatgtaaagagtaatatgatgtggcattatcatgatttctagtaagaaaacactgctgtttggtttgggccaaagaatgaggaaactcatagaggatggctctgcatatttctaaaaccaaaagaggatccagtacaacaaagaatcaaaaccctggacactggttaagaggagggatgaatcactggaatcacttgagtccttagtattttgctgaaatgtattatgcaatatacatccttttctccgcccaatttttgtcctggctgtgaagatagcagttctttatgctttgacatttctgttttgagtttcaaagtcagagtgataaatagagtagaagaacttaggatttagacttttaaataaagccagggaatattctattaaaaaaaataaagagaaactgttgagggacagagttactagctaatttatttatttatttatttatttatttttgagatggagtttcgctcttgttgctcaggcaggagtgcaatggcacaacctcggctcactacaatctctgcctcctaggttcaagcagttctcctgccttggccctgcaagtagctgggattacaggcacgcgcaaccacgccaggctaattttgtatttttagtagagatggggtttctccatgctggttgggctggtctcgaacttccgacttcaggtaatccacccgcctcctggccttccaaagtgctgggattacaggcgtcagccaccgcgcctggtcagttgctagctaatttatatacttttattactgttgtttgttttaagacgaagtcttctgcctgctcacactatacagaatgagcctacaggaacaaaacataagaggtgcaatttgaggactgtcacctctgcctgagaaagtatctccatgggtgcttattaataatgatatattttaaaaagttgtaacagaaagttccaacaggttgaaaacatattatcttctcattgacaaaacagatagcatttattataccatgtgtggcaatttatttggcacattgtggcatccctttttcaaaggcttttcttgccagcacattcatttacctcttcatgatttttttggtcttatgtttttaacaagactgagcagaaagttgaagactatgtgatagatcccttgtcatcttccacagtgcttaccatataatgattggtatagataatcttatggatgtcatgtcttcaatatggcttataatgaaatgatagctaccatttcattgagtgtttcctatgtgatagacattctgatgagttttgtacacatataattgacacatcctacaataatgcagctaaggaggtattatttttaacacatgagaaaatggagtcacagagacttgaatggtgagtctcatttacataaatagaaagcagaagagccaagttttctctgactccaaacgtatgtatcatcacccccaatgctagaaaagtatctaagaagactatatttaagaaaagcctcatattgctggcctatttgattttagtctgttgttttgtcaatccaatctaattccacatgccaaaataattgtcacatgttagtctaaagctaacttcatgtctgatagcctagagcagctaccacattcatttgctaataaaatctgtcctccgtagtctggctttcaagatatttatccattaattaattcaaatctcatctttactcattctcctttaaagctcatcagatcatttttaaaaataagtttctgccaatatcatgtaaattcagcaatcacagtccatctgcaactcccccatatgtggagggggcctagttatatggtgggaaaaacaactgggcttgaaagtttttagtacattcttacagcaacatttcttaattccctgaccaagctgtctacaactgtgcacctatctccacaattattttgtatctttaccctgagttatttttcttcataatactaattaactgtattagtaaggttaagtaatgctacattattctgtggaaataaacaaacctcaaacctcagttggttatcataataaatttttttgtgtgtgctttccttatagcctgatatgcatcagatcttcctcctctatctccttgctgtgtgatctggaacatgtaaactctaaagagaagatgacaagaagagatggaagaggctgttcactggcttggcttgaaagtgacgtgcatcacttttgttcaccagtcaactgaccagaacttgtcacgtggccctaatctaattgcaaataatgcaagggaatgcagatgagcatatgtacatttgttacgcactatctctgtcacattacctcacagaacagtatatatttatttgcttctctcccctctctcccttcactaaaaaattcatttatatggctacagattttgttgtattttccatgccaataagatcaagtagaacagtggctggtacacactggtacacagtgggtactcaaaataaattgttgagtgaaagaatacttgtaagtgattaaagatggccacacattctttgatggttctttcgttgagaagtggcatgaatttatgataactgtgaccaaacaatacggcagaagtgacactatgctaactgtaggcctagcttgcaagagagtagacagtttccactttcttcctagtggggcctatcctgagtccaggaagcacatgctagccacttggggatgctgcatggagagagagagagagagagatctaaacaacccccagctctttcagtaccttctgtttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagtaccttctgtttatcttatgtgaggtcacagacattgcagagcagagatacatagttaccctccaaatccttgacccacagaataatatataacaataaataaatgttgttttaagcccgtaagttttggtgtggtctttaatattatgcagcaatagataattggactaatattcatgatgactgacccttgcatgttcaaccccagtacctacagtctaaactatacacatttattatctctaaggaagaaaggctcaatgtttttaaaagatgcctattttttcgtatcaatgtacaagtgtttctattctgtgaagtctttaccctctttctggtcaaattttgaagactgtcttcttttatatacccagaaagttctgcatggatacatcctgccatagcactcaggacacctgattacttctgtgtgtttattcttttgctgtaatctgtacaaggatgttcactatgtgacacattccaggacacattctcagtgacccctagtcattctacactctttaccttccactccaggtggcaatttgaaacacaagtcaaagagagtgatgttcttacaggcatggtttttaacctatgcccatgaattaaaaacaatttaaaaacccaatctttcactttagctgttgttagttaatctcacttgtatacacattttacaagtgactctcatgcatcttgcagcttatataaccaccaattcagacaccagaggtgacagtagctgctataatatactcattggtttaaaagtgtttgttttcctattagttgcaaaacttttaagggcaggcagcttgagtcccagttacccagttgagataacccacatctgctaatatttttacataaaagtcagtgaaaatataattggcaatgtcatgcaaaactggaaataaatatttactatttttaagccattttggtctataatttaatcacaagatcgttatacttggaatgcaaaaggattggatcatggtggcactattttaaagtctcatttaaatataactaaatgctgcaataggtggtcataactgtagtttgactctaattaatataaaataattggagagtaaatttatccccctgttccatatcaatagctctttggctacaaggcaaaaagaatgtgaacattttctcggtatcaataaaaattagcttaaatatctaagtcaatttagaaatgataaatcagtctccatagttaaagaccaaaattttaaataaccatattaagcaagactcatatatttttaggaatgctctcaaaataaaaatctctcttacaaaccaaaggaaacaaatatagttgaataattctataaacctttcacaaaaatatggcattatggcataaggcaaatatgatggttcaaccagctaagtaaacactgattaagaattaagattgaccacagcaataaggggtattttcctctagtcaatcactcaggttcagaaataccaaatttatcttaagacattctaattaggcaaaactatttgatagatcgagtagttggagatcagaagcatgcatccaattaagaagaatgttattgaatgattttcattcactggcctcttctgttctctgtattttagtttaccttcagcacctcattgaagagagctatatccaaattcaatttattgccccaagacctctttcaaaaaaatggctctggagattcccagctagaaaaacttttctcttctcctaagcttccataacatgcatcagggatttggtatttctccctctgaattgtaattgtttctaggcactagcttctctgccagcctggaagttccttaaggagctgagcccatgttttattcatggttgttcctctgtggggcacagcacttgggcttcccttctttgagcatcaaaaacaagtgtcatttttctttcacttattttcacatccatgtcctcttctaagacctttgcaagtcattcgtagttttaaagagactacatttaagttttgatagataagcaaggtaaatggcaagtccagcagtatagagaaaaacctctttcctgtagtggtatttgttatatattttatctgaattttgaggttcatttgttttcattattgacagatgatttctttgtttgtttaataaaaagcagtaattaattttcccttaattacatgttttacttgccactagctggtgtatctagggattcatattgtaaaaagaaatggaactcattggtttgaatcataatgtgtgggggtatagaggttatttaaatattgtttagttctttttttttattttacacataatagacaattctcaaaatggcagtaaggaaaaaacaactcattctttatattttgaaaatttttggccctgaacacaaaactttaattgtaacctttaatttattaaataaaatattgagcttctaaaacatttgagagtgtgcagcatattgcaaaagatacttggaagaggcaagctgatcttgctccaagaagcttctggttaaatatcaatatgatgaggtttgaaaaaggtacacacaaccactacattacagcatgaagtaagatttaggctgcaagagagatgcaagttacaaatatgaaataagtttgggctgcaaggaaaattgactctggcacaagttcaggagcattttagattagcaaagtagaattgctgggagttcaggtcttagatatttcataaaataactacacctcaatacattggaatttagaaataaagagaccattagtgagattccatttctgcaatattgttttttctaactttgtcccttgttttttgtctgttcctatcctagtataccaaattatcatcatattccctcccatccatgattctagcattttagataaatcgtcttgccattttccaagcgtttggaattgaggtccatgctcatgcccttttctaagaattccaaactccttgagcttaatcttatatcttcttttaatatccctgaactaaatgactctaatctagaatttgtacatatgaccaaaatgacaaaggtacttcccatgaatccccaaacctcctgatattgtatataaaattgtgaattttcctggagttagactacatgactttggttaaatcctcaaaaggagctcctgccccactgaatttaagaagttttagtacttacagaccattggggatatattacacacagaggaggtacaggcaatgtcttacaaaaggcacttgtaatggcagtctttatgatttctaggaagtatgcagaaaaatttcctgaaggtaatggtcatccaaaaagtcaccatggaatctcttctcctgcaaggaattcattactgagtaactccttacctcttggtataattttggcatggagtgaaaggtctaacctctcaatgctgtttccccttctgtacctcctctgtctctttcaggcttaataggatcatctgttgacttgaatcagagtcacattcaaagctgtgaccatcactgacttggcactgtctgtatctgtgtgagtctccaggagaggtgctagtgtctggggctggaagggtgtaggttgctggtaattcagccatgtgcatttgctcatgaatatgtgtataataagagagagacagagggggagaagaagtggagaggggagagagatgagagagagaaagagagagatcaatctgagagagaaagatatgtatacacacacacacacatacacacacacacatatatatatatataaataaaaatctgagagagagatcaaatctgatctgtaattgtatccacttcagaccaaagggaccacacagataaatataaataagtgaaaagattcagtggggtcaatggaaatcaagaagagggcagtcttggcagtttcttctctattctcactgatttcattgattaaacgagaaactaatgtcaagtcagagatatttttatgcaaagctgagaatatggatttttgggtgcaattttccaaagtctatgcattaacaactaattaaaaacatgtaaaagaatatagagcacatagaggaaaattttctcagtttgataaagaatggctacagaaaacgtatagctaacattgtacttaaggtaaaaaaatctagacactttccaattaaggtcaggaacaaggaaggattcctctctccacttcttttcaacattgtgctagaagtgctagctaagaaaaacaagacaaaataggaaataaaatgtaaacaccttgtaaatgaagaaataaaattgtctttgttctcagatgacatggtcatctctgtagaaaatacgaaagaattgataaaaacaactcctggaactaagaagtgatagtaaggttgcaggatacaagattagtttataaaagtcaatcacatttctatgtaccagcaatgaacatatagaatttgaaactaaaagtacagtaccatgacattagtatccaataaataaaatatctaggtataaatctagcaaaatatgtacaagatctatatgaggaaaactacaaaactccgatgaacaaaatcaaagaagactaaataagtggagagctatcccatgcttatggataggaatactcaatattgtcaagatgtaagttcttcccaatttgatctacagatttaatacaatcctaatcataattccatcaagttattttgtagatattgacaaaatgattttgtagatattgacaaaatgtagatattgacaaaatgtagatactgacaaaatgattctacataatattgacaaaatgtcaatattacgtagatattgacaaaagtttatatggagaggcaaaagatacagaatagccaacacaatattgaaggagaagaacaaagttagagaactggcaccactcaacttcaagatttactataattaagacaataaacaaagaggctgggcatgctggctcacgtctatgatactagcactttgggaggctgaggtgggcggatcacttgaggtcaggagttcgagatcagcctggccaacatggtgaaaccccgtctctaccgaaaatacaaaaattagccaggcgtggtggtggacaactgtaatcccagctactcaggaggctgagacaagagaatcgcatgaacctgggaggcagaggttgcagagagcagagatcacaccattgcactccaacctgggagacaagagtgaaactctgtcaaagaaaaaaaaaaaaagaatagacaaagaggtgaatggaatagaaaaaagaattcaaaaatagtcccacataaattagtcaactggtcttttacaaaggagcaaaggtaatacaatggagtataaatacagtcttttcaacaactgcttctaggggtgccagactcaacaaacctgaatactcacatgcaaaaaaaaaaaaaaaaaaagaatctagagacagaccttatactcttcacaaaattaactaaaagcagatcatatatctaaatataaaattcaaaactgtaaaattcctaggagataacatagaagaaaacctagaagaccttgagaatggtaatgacattttagatacaacagcaaaggcatgatctatgttggaaatcattcatatgttggacttcattaaaattaaaacctttttgctctgctaaaggaaatgttaagaaaatgcgagacatcatacactgcaagaaaatatttgtaaaagatacatctgacaaagaatcattttccaaagtatacaaaaaactcttaagactcaacagtaagaaaaaaacaacccaattaaaaaacatgttaaagaccataataagaagcacctcccaaaagaagatatacagatgggaaatagcatatgaaaagatgcttcccatcatatgtaattacaggagtataaattaaaacaacaatgagataccactagaaatgtatttgaattgccaaaatccaaaacactcataacactgaattctggtgaagatgtggaacaacagaaactcctatgcattgctgttgaaaaaggcaaaatggtacaaccagtttggaaaaccttttggcagtttctataaaaactaaacataatgttatcatatgatccagcaattgtactccttggtatttatccaaagaagttaaaaattttgactgcagaaaaacctgcacatagatatttatagtaggtttgttcataattgctaaaactggaagcaaccaagatataccaagaaaccaaaaaactgaaagtacaaaggtggtacatacagacaatgaaatattattcagcactaaatataaatgagctaacaagccacaaccaatatggaggaaacttgagttcctatatttaattcattctccctattactaagtgaaggaagacagtctgaaagggttgcatactgtgtgcttccaactgtaatacattctagaagatgaaaaattatggaaacagtaaaatgataagtggctaccaagggttggcagaaagggataaacaggtgacacacagaggattattaacgaagtaaaaaatactctgtatgatactgtaatgatggacacgtgtcattatacatacatttgttaaaacccctagaatgtacaatatctagagtgaaccctcatataaactacaaactttggggaattatgatgtgtcagtgtaggttcatcaagtgcaacaaatatgccactctggtgagagacgtaaataagaggagaggctgtgtgtcggggtgggtagggaacatatgcagtatctctgtgtcttcctcttcatttggctgtgaatctaaaactgccctaaaaaagtctttcttaaaaagagtccagaacaaagacaaaacgtacatttgttgatatggaacctaggtagtctgaagtttgcatactttcatctatagcttaatctccccacctattttcctccaccatctttgtagtaaatttgaactattctgtatctacaaaaaaaagccttgaaatttcctcacagcttattcttataaaatcctctcagtttacaattcgttctcttgactgttctacttccttactctaccagtcccagattatccgcctccatgatgaatcattttttcttctaggaccatgaaacatataatctctatcatctgcatggcaaattgtcacgtatttgtccactgggtattctttctgatgttgctgttgttattttcacatgttcatgtgtctgtctcatttcccttcattattcattcatgcattcattcatttgccctacatacacccattctatattctgcatccttgtgcttgacactgaagattagaccacagagcaagactctttccatgctttgtaactcaccgtaagtgtacttctaatacacaagatcaatcaagaaggctattataaacctttgtgacctgaaaccctctgaaggctgtttgtattgatatggtggtatggactgaatgtttgtgtcccctcaaaatttatatgcagaagccctaaatccaatgtgataatattgggaagtggggcctttgggagataattagatttcgaggaagtcatgaaagtgggttcctcatgatgggattagctcccttatgagaagagaacagagcaggctctctctcagcctaaggtctgactgatacacaactggtattcagaaatatttattgtttggttacttattctcatttgcaataagttataacatattaacaatatattcctacatttcacagtgtggatgctattgttgttgccactgggtatctatgtgggaactaattgaggaccacatttacaatgtgcccaaattgtaaatgtaggagtatctatgtgggaactaattgaaccactgagtatctatgtgggaactaattgaggaccatgtttacaatgcgtacaaatcataaatcaattagttcatattgatttacaaacaaggaagaaaaagtatttgtttacattgatactgtccatgtaaacttttttcaattcaaaagaaacacatagttctgtcataaagtagattttctatcccttttattttctgagcttatttcagaaagcacttgcaatagctttgcacagttcagcatttatgaaggaaacctttgttagcctaaaatgtagctgtaattttttttcaaataatttctacacaaagcttttacaccttatttgattacctcaattttttcccaatgagtgaatacggacttaaattcattttttataaaaagcattaaccattgtttcttgtaattacactcagtgagagtcgaacaatagtgtctccatttgaaacagacttttgttataaggttgaaattgactttaaattcttttgaaatggccccaaaataacacatagcacagtggtcgtctttgaggtgagaattatgtgtcttattattgagagattggactgtgtttcacagaaaaattctcatgacctactaatgtgtttcagtcaattgttctgaaagcacaggataagaattgtaatgataatgatgaaaatatatgaagacattgaaaactgaggttctcattgttatagcatgtcagttatctttatctcattcaacagcatattttaaaatgtcacactgatttccaaagaaggaagaaaaatttaaagagttcaggcaatgcatgctagttaaacttattgtgataatacattcatagacattgaaaatattggacaaagaatgaaaaaagagagaagaaaagcatgcctaaagatagtcagtgcttggccagtatatatcttagggcagaattcaatgactcaggttgaaaaataaaaacctatctagatattttgggtttcttctctctctgattaatcaaaatacaacaaggcagaaatgaggaaagatgcaaacttttagtggccaatgaggaaatataccttgggggcatatatggtgagtccaaagattggtggccaagaataatagaaaaagaagagatgcagtagaacaagaaggacatatatcatcatttatctctgctccatctctccatttattctgcaagtgatgggcgcaaaggaagaaaacctgtgcaggaattaaaggggcagctctacagagtcactgagagctcattgtccagacttggataaaaatgggttcctagtcctgcctcagtgagtattacttgtgtccatgatcatgtcacttactgcttctaaactccatttgtttcacctgtaaaatggggataattatggtccctaaatcatagacactggagatattaaatgatataatgcagaggaagaggactgagtcaatgtctggcatttactaagcctccagtagagcctagccataaggtttctattataattaaaaacatataaggaattttaaccattctttgataagtttagttacccaaacttttttctataataagctgtcctataacactctagaactgaagacatgtatcctcagccacactatgtttgactcagctgtagagagctgtcttgcccaatgactgactgtggtaggaacccctgattcttctgattaaaaatgatattgtttgacagtgtccccacccaaatctcatcttgaattgtagctcccataattctcacgtgtcatgggagagacccagtgggaggtaattgagtcatgatagtgaataagtttcatgagatctgatgattttatgaaggggaattcccctgcacacactgtcttgcctgctgccatgtaagacgtccctttgctcttccttcatcttccagcatgattgtgaggcctccccagccatgtggaactgagccgattaaacctcttttctttataaattacctagttttgggtatgttattattagcaaagttacacaagataactctgacaccacagaactccctgaggtgttgattaagactttgtgggtctaaaaatatccgactttttcctctgagcaattgtacttctgtactccctcttccagtgacgttaatctctaatcctgaatgctgaacttctggagaacccaatctggttcattagcgccaactattcaaattgtcttcagggagctagtgctttccttctttctcacaaaattacatggcttacattttctgctgctggggaaccctcagccatggatcctaaggccaaggatggacggagaaattccctgacagtctattctaggaccatttgaaaaagagggacccgagaccacaccagagaaggagagagttggggacctaagtcctggggaaaggaataacaggaattagggcctgattactgatctgggcctgctatttttaaggaaagtgtatttatgggatagaggggagggggaattattcatcatgatattagttatagattctagagatctagagaaataagcagaaaataaaaactacaagaagatgtttaacctagaaaaatgaataattactaattaatttatatgcatctcttttcatttcattcatttatcactttagtcactcaacacaatttaactgagaaattatacaacatgagacactgtggtagactgtgtggggtgaagcgttgactgaaacctggcccttgtcttaaaaaaagaaaaactcacatttttgcctcattatcttccataacaacataaatatattttattatacatataccagatacattttgtttgtcctaatcaattctgtcttatgggaacaacctatacctaaaaagattggagatttgtatcacataaaatgataaaaattttgtttcattattttatagttatagctcagaagttccagtttcttggtgttcttttctggtattagaggtacctgcttaaacttttacaataaagaatgaaagcattggctaaatgcattcccagaggctttgaataacaactctggcaactggtttgcccacaaaattgagctgatttataacagccttaaaaaattaattaaatgcataatatatattagctgaataatagactgagttgggaaggtttttcagtagataatatcttgcggttaacccagaattttttccctacacaaaattaggggcataaattactattttatttttagagaaactgtaggcatcagactggatgttacaaaacagcttcaataagacatagaaggccattgcattcctcagttaaagggaatgtttgttgcaaagataattattcttttcacaaacacctgtgcttccttttcaagtgcagagtaatactaggcagtggctgcccagccaagaacattacctgctccggttgcatataaaggagtcatgtgactgatttcagccaatagaatgctcataagtaagaatagttaagaagtaatggggaccctttccaacttctctccctccaaatgcaagcatctagctaagtactcagagtcctgaagagattgctgaagcaatagctgggaagagactcactccttaaagaattgtttgaaagaaaacttctcacgaatcagaaacacctgtttagactttacaagcatgagctatctccttctatttgtatatttatttgttacagcagcaagcattaccttaaagtatattgaaagcgtgtggttgaatgtgaaaatgttgtacggaaagatagggaaacatatgctaatgacaaattgggtccaagataacgagcctgttaaaagatatgcacgtcttttaaatgatcgaatagaattcattataacattttattcccagtaggaaaaattagatttctaaaagaatggtagcacttgtggcaagatcttatgttgcaagtacagtagatgaatgaagagaaactgcttaacccccattctcttaaagattaacatttataatttgtaatttgcctttttacatgtgcatctgtattaacacatgcccatctgaaaatatattcggagctttaaatatatactatagggttttgtcaagaattattaaaggagataggatcacatttattcaatgtgataaataattctagaccctcccatttggagaagaaaagaaacaaaaatagtttactggcttataatatgcatgcataatttttctttttcataacacaataataatgatacaaaaaacactataatcctatataagcaaaagtgcttagttctgggtcaggcaaattgaaagcaaggtggtgagccagactcagcaccatattgatgagaatcacaccttaatagatggagaagcaagtagaaaggggtttagatgatcttacataacagaggcttttaatcaagctggaaccctgcctacctctaaattattacataggagaaaaagacttttattttaaaaattcaattgtattttaggacctttctgtaacaacagtgtgatctatgcctaaacattatatgatccaaattgtgccccttgaaatttcttatgttgaagccttagttcccagtatctcagaatgtgactgtatttggaaatggggcttttaaaaatgtaattaagttaaaatagagtctttagggtaagccctaatttaatgacttgtgtcctaataagaaaaggagattagaacaaaaacaacacatacagagggacaaccatgtgaagacacagcaggcagatggccatctacaagccaaagagagagccctcagaagaaatctatcttgttcacatcttgatctttgacttccagcctctacaattatgagaaaataaattgctgttatttaagccacccaatatgtggtacgttgctatggcagccctggaaagtgaatacaaataatacataattcatgcattcattccttcaacctttacttagcactaattttgtcatatgtcctgtgctaatggatgtagatgacaatgtaaattaaattctcctatgtcctcaagcaaatcacagacaaatggataagaaatctctccttccattatacagtggctccttattatggaatcttgctatttaaataaaatatattccatcagtgataggttaaatggtgttctcccaaattcacatgctgaagtcctagcctctagtctttcagattgtgactgtatttggaaattttgtgactatagatgtaattagttaggatgaggtcagattggattaggaggccaacctaacccatatgactggtgtattagtcaaggttctccagagaaacagaaccaatcatatatgtatgtgtgtgtgcatgtgtgtgtgtgtgtgtgtgtgtgtcacacagagattattataagaaactggcacacaattatagagtcaaacaaattgcaagatctacatggtgagtctgcaagcaggagagccaggagagctggtgctatagtttttgtttgaccctgaagccctgagaatcagcagagccaatctttcaacttcagtctgaaggccagcaggtgccagacccaggaagagctgatgtttcagtttgaatttgaaggcaagaacaattcccctttacttgagggagggtcagcctttttgttctatttaggttttcaacaaattggaggaggcctgcccacattaggatcattaggaggatgatctgttttgctcagcctactgaatcaaatgttaatctcatcacaaaacattcttacagacacactcagaataatgtttgatcaaatatctgggcaccccatggcccagtcaagttaacacataaaattaatcatcaaaactgatgttcttataaaaaggggaaatttggacaacaaaaaagacaagcatatagggaagatgggacaatgtcttttaccatgagcatatcaggctaccagatgctagggagaggcagggaacagctcccttacagccctcagaaggaactgactctactgacaccttgattttgagctcccagaatcaaaattcttgtcttacagtaagacaataagtgtctgttgcttaagccacccagtttgtgcaactttgttatggctagctttaacaggttacaccatctattctacactaaagttaaatattttaaattctggaatcagtaaacaaaccctgctacttgccatttggggttaggggagtaagctatgtcagtccttcacagtttcttttcttgatatctttttatcagcaattcactgatatacccactattctttcaaccaacacttattaagtgtcttcatccatatctcttgtattgtgctataaagcttatgataaataccactgagcagaggatgctaatcacagagttaactgtagtgtgattcttggggatatgtcaaacaatgaactgagactgatttatctttatgaattcaagttgcttatatcacaccagtctaaagaaaataaattccaaaaataatatcacttttaaatcaaaattgagagacaagaatatcaaagagactggatagactctaacttttatcaaaaaatgatgtagataccagtgggaaaaaaatagaagattcttagaagatggttattttagagatttgaggggaagtaaagagaagagagaataaaaaaattcttaatcaaatgactcaagtttatattaataatatgaaatatttttaattatctcacaaactgaatacttgcatccgagtgtccatgtcaaggaaacaattttgtgtttaaacctctgcagatccaaagattcatactaacatctcaatggttgaaaactgtcattgaaaggaaacttgaaaataattaattcttaaactgcttaatttttcacttttcatttcacggtttgtcactaaaatagtaattattttttcttctcttgctaatccaacaatttcatactgacagcctttcactgggaaatttactttcatattactgctttacactttaaatacaaatatttttcaagatgaaattagatatgttggcaagaaatatgatctttagttaatgatttatgtttctgctttggaaaaagaaatgtctcttacatatattatacagacaagtggcttccaaacattctgttgaagtgttcaaagggaatgctttatgattattgctcaataaaaatagtgtgttggcatttttactcccgttacctcacaggaaaaaaaaaaaaagaaaatgctgcaatagtatgtcataacaattaatagtatgtacactggattttggtagaccaaactataagtcctggattttattttaccaattctgtggtttaggtaagtggtttaccatttatgctatagttatcttagctataaaataggaccattggagtatacacctctgaaggtgtctggaaagactgaataggaaaattcatggaaagaacttatatagaagggaaataaataagtgctcaataattgttagttgaggctgtaataataattacttattgagtgctattcaagggccagggattgggctatggagtaaagacataaaaatgaggaattcacatgtttctgggacctcgctaaatgtattgtgaaattaaaaaatggcggtatatgtgaaatcactttgaaaaagaaaaaaactctacataaatacaagaaaaatctctcaagacagatagtagccaatgcacaatttaattccaaaacatgggtcagcttcttactttggaatgttatagttttaatttaaattattgccaatatttaatattaaatacattgaccacctgttcattaattgatgaactcaattatactatcacttatgcattctccaaacatgtacaagtgtccactctgtcatgggaactccccagccattctggcagccctatgttttgtttctcaagcacgtagtcacacctttcttcccctttaatgtcagcttattttttcttcttggttgactttctaggggtgttctatgacacgctgagcagcttgtggtgaacgtacaagtgtcttaaaataatcgagtgtccctacactaccaaagtgttaaatctaattgaagaggccaccatgaaaatgagtatctggcacagccttggctgggcttaggaaagcaacaatttgagaacctagatgttggcagatgaccgtattaagatctactggaactgcatttaaagatttcatatgcatgacaaagcccatctactcctacaattggtttgatttacagcccaagataatggtgcttctagtatctcaaatactaaaaaaatcatatttaattgctttaattcactattaatcgattattataatgtactgctaaaggacaattctttctaagttctacaagcacaaataacatgaccatattatctttccaaattgctgactgtacaatattgtgggaatataaactacaatataatccagtggtttagtagctgttactactgtgaaaaaaatatttaggaggtcattatatcatagattggtatcatttgtctatatatatatatatatatatatatatatatatatatataactcaattttattttaaaaaatagtaaaagcaaacatcacatgaattaagaatgtattttatactttaagatttattttcaaaatgtgaatgtaaatcagatcttcccatcacgaccccagaagaataatgatttattttaatatttgtgattttaggatttagatactacctacttaccaagatactcacttgtaaaatatcttttaagaatatagaggcaaaatagtgtagcatagaaaacacattgaaagttcatattaatagccccttcgagtttttatagaccctagggtaaaaacaaacaaacaaacaaacaaaaaacctccatcccttgcctcagttctcattcatgtggtttgtttataggatcaacaacaccggtgggaaattttacagtattcttcttattgtgggcagctctgatggctccaaggttctttcttgtgctgagcaggaacctatttactgtggcttccattcagtttcagtattccttttagggctaaggaaaataattctcagaagaaggccaagcaacatggtcaaatagaagcacccagcaattatctctcttctgcaggaacaccacattgaccaactatacacacacacacaaaagcaccttcttaagaatcaaaaatcaggtaagtgatcacagtagctggttttcacatcatattgaggaaagaggcactgaagagggtagaaaagacagtctttaatcacctataccatccctccccccatcccccgcatccccctcatcccctggcatgtattgccatgcggcactgagagaatgtctgcgcctggggaagggagaatgcagtgattgtgagacttagcattggaactcagtgctgtcctgtcacagtaaaaagtaacatggggtggaagtcagccttcatccacagagggagcatttagaccaaccctagccagaggcaaattgcccgtcccagttgtcagaacatgagtttcagcaagccctgccaccatgggcaaaaggactctggggtcctacatcaacttgaaaggcagtctaggccatgaggactgcaatccctgggcaagtcctggtcctgtgctgtgctgggctcaaaggggccaggggacttggagtgcatgtgacctggtgagataccagccgggatgcatgagggatgcttgcaccaaccctcctcaaccctaggcagtatagttcacagctccaaaagagactcattccttctgtttgaggagaggagaagggagaacaaaaagaactgtgtcttgcaacttggataccagctcagccacagtaggacagcgcaccggacagagtcctgaggccccattccaggccttagcactcagatgacatttctagacacgcattgggccagaagataacctgctgccttgaagggaaaaacccagttctggcaggattcattatcttctcgctaaagaacccttgggccctgaataatcagcagtggtagctaggcaatacttgcctctgatcttgggtgagactcagaggtgtgctgacttcaggtgagacccagcacattcctggctgtggtggctatggggagagtctccttctgcctgaggaagggagaggaaagagtaaaggggattttgtcttgcagcttaggtatcagctcagttacagtgagatagagtgccaggcaggccctagggttcctgattccaggccttggctcccagatggcatctctgggtctgcccggcattaggaggaactcatcatacttaggaggaactcatcctcttagaaagaactcatcacactaaaaggaaggacataagcctggataactttgccacctgctgagtgtagagcccttggtccatgagtgaaaataggctgtagccaggcagtagtcactgcaggccttaggtgagacccagtgctgtgcagtcccagtggtggtggccatagggatgcttgcattacccctctcccagctccaggaagctcagcacagagagagaccctgtttgtttggagggaatgtggttctgaatcattatttaggggaatattgtctgaacatggtctactttgaagtttctcaccctttctcataatatgtcccatcaacataaatattatcaagcttcatttcctataattttcattatgttgcccaaatgaaaatattctgttgcaaattattgaaatgtaaaattttgtattaaagtataaattatttgttaaaatatttaaaatatgattggttattctacatacagaaatgtctttggatatctcagtatgttctcatctttcccctgtcctatcattattcttccagtgactcatgccaagaattgatcacaatgctccaagggtggtctgaccagcagggaactgagcagaactgaacatggcttcctgttttctgtacccaatttctttccctttttctggtaccactcatgtccacatcataatcatcttttgcctgaacaatctcaacaggctctgacgtggtcgtcctgcttcccccatgaatcctgagtgtttaccttccacttagtagctaaagggctcttttgaactcataaagtttatcaagtcatcacctcctcaaaacgttctatacacttcccataataatgagcatgaaatccaactccataccctatgtggtctatataatctccctttcctcagtctccccttattccattctctcttcactcatgaatttccagccaaaattttcttctaatgtctcaatgattaggtcaagcaggctccacacagtagggtgtgtgcactgattgtctttgtgtggaatactttctctctctctgcatatttacatggctgtccttttcttgtcatttagattttagttgatatccctcctcttcaatgaggactttcatggcctccaaatagtaagtagcttctttcatcaacttttatcatgtcaccctaaatgtagtaatagtacttgccaccataaaatattcttatttatttgtttattgtctagctgtctaatgaggtaagacccacaacagcagtaatcttaataattttatttagaataatgtttggaatataaatattgttgagtgaatgaatgcatgcatgcatgaccacagtatagatgtgttattgtatatgaagctattaagatcaaagagtttgagcctgggcttgaattgctgatctacatttactatggtgagtctaaacaagttacttaacctatctgtgcctgagattgtacatctaaaaaaggggcagataaaaatgttactttcttctcaaggttattgtaaggattaaataaataaattgctctttgtaaaatgcatagataactactgtataaatgtagcaataaatagtagtacaacccaatttttagaattttggcagccacactattgactcatattacacctaaagtataatgtaaattctctaagtttttttttttaacgtgtgctgctttgaagtctcacctctatatttttgtgcttacacagctgccttttagaagccaactacaggattttatattggtccgctttatttggtttcattcagcacatcattctactctgttgacaatgctgaaggttttgagttattgattaaatgtcaccttggatatttgaaaccaggacttcaatctaaaaatctaagctacttaactcaagtgacctcagtctagaggactctgagtattcatggggccagtgtgttgtcttctagcagtttcctttcacttgcccggagaagaggcctgtgaaggctggccctgggtctgtaaaacacataccagaagtgggagaggacataggttaaaagcagattgacagaggaggatcaaagaagccataagtatacctcagctgacaatgaccaagcttatgggaagaagatacagaaaaatagaaatttggatgtagagcaaatcttattttttcactttttattttgaaataatgatagattcataggaaattgcatagttagtacaaagaagttctaagtacccttcacccatttccatcttacatagtacttaacaccaaaacacgactttgacgttggtataatgtgggtgtgtagttctgtgtcatattagcaaatgtgtagatttgtgtaatcaccactataattaagataaaaaatattctatcaccacaaagatctctcccacactttccttttacaatcacgtacccaaaccctcattactcctgactctgggcaatcactaacctcggatccaactcgataattttatcactgagagactactatataaatggaatcataccagatgtgacctttcaagattggagttttcactcaatataatgcccttgtgatccatcctagctgttgtgtgtatcaatagtttgctcatttttattgttgagtagaattccatgctgtggatgtaccagagtttgtttaactgctcacccactgaggcatattttggtcttgtttttggcgattaaaaataaactgctgtgaacaatcatgtgcagattgttgtgtgtctaggttttcatttctctgggataaatgcacagagtacagttgctgggttgaatggtaactgtatgtttagatttttttttttaaagtgtccaactagtttaactagttttttgagtggtgtactggcttatatttccattgtcacagtttttactttagctgttctaataggtatgtagtgatatctcattgtcatcttaatttgtatttccctaatgtctggcaatggtgattagcttttcatgggctcactggacacccatattttctttatgattaagtatgtgttcatatctttttctcattttctatttgaattgtctgtttttactgttgagttttgagattttttttttttttttttttttttttttttgagacagagtcttgctctgtctcccaggctggagtgcggtggtgcaatctcggctcactgcaagctctgcctctcaggttcaagcaattctcctgcctcagcctcctgagtagctgggactataggcgccggctaccatgcacggctaattttttgtatttttagtagagatggggtttcaccgtgttagccaggatggtcttgatctcctgacctcgtgatctgcccacctcggcttcccaaagtgctggaattacaggcttgagccaccatgcctggcctgagttgtgagtttttaaatacattctagatatgaattctttgttagatatgtagtttatcaatatcttctcccagtctgttgcttgtcttttcatcttctcaacagggatttcaaagagcaaaggttgtttaattttgatgaaatcccatttggttattttttcttgtatggatcatgtctaagaactcacaagtcccaggtcctgaagattttctcccatgtgacctgctacaagtttcatagcattacgttttacatttaaatcaattgttcattttaagttaatttttgtataaagggtgaagttaagattgaggttcattctgtttgtttacctgttgtccgatttctcaagcatgttttgaaaagattattattcctccattaagttgttactgtttctgaacctttgaccaaaggtggttgggcaaatttgagcgtctttttgggttctttgttctgtttctttaatctgtctttctgccataccacacaggactattgctatatactaagttttgaagtcatgtagagtaactttacctacgttattattttgcaaagtagttttagctattgtagtatacttggctgtctatacaatttttagaatagttttgtctatgtgtatatatatctgttgggattttatttatttttttatcttttgattttttaaattatactttaagttttggggtacatgtgcacaatgtgcaggtttgttacatatgtatacatgtgccatgttggtgtgctgcacccattaactcgtcatttacattgggtatatctcctaatgctttccatcgtccctccccctaccccacaacagtccccggtgtgtgatgttccccttcctgtgtccaagtgttctcattgttcaattcccatctatgagtgacaacatgtggtgtttggttttttgtccttgcgatagtttgctgagaatgatggtttacagcttcatccatgtccctacaaaggacatgaactcatccttttttatggctacataatattccatgatgtatatgtgccacattttcttaatccagtctgtcattgatggacatttgggttggttccaagtctttgctattgtgaatagtgccgcaataaacatatgtgggcatgtgtctttataacaacatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcatctgttgtttcctgacatgttaatgattgccattctaactggtgtgagatggtatctcattgtggttttgatttgcatttctctgatggccagtgatgatgaacattttttcatgtgtctgttggctgcataaatgtcttcttttcagaagtgtctgttcatatccttcaccctctttttgatggggttttttttttcttgtaaaaaaaattttgtttaagttctttgtagattctggatattagtcctttgtcagatgagtagattgcaaaaattttctcccattctataggttgcctgttcactctgatggtagtctcttttgctgtgcagaagttctttagtttaattagatcccatttgtcaattttggtttttgttgccattgcttttcgtgttttaaacatgaagtccttgcccatgcctatgtcctgaatggtattgcctaggttttctcctagggtttttatggttttgggtctaacatgtaagtctttaatccaccttgaattaattttcatataaggtgtaaggaagggatccagtttcagttttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtgccatgctgttttagttgctgtagccttgtagtatagtttgaagtcaggtagcatgatgcttccagttttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccattatttgtatcctcttctatttcattgagcagtggtttgtagttctccttgaagaggtccttcacgtcccttgtaagttggattcctaggtattttattctctttgaagcaattgtgaatggaagttcactcatgatttggctctctgttattggtgtataagaatgcttgtgatttttgcacattgattctgtacctgagactttgctgaagttgcttatcagcttaaggagattttgggctgagacaatgggattttcgaaatatacaatcatgtcatctgcaaacagggacaatttgacttcctcttttcctaattgaataccctttatttctttctcctgcctgattgccctgcccagaacttccaacactatgttgaataggagtggtgggagagggcgtccctgtcttgcgccagtttttaaagggaatgcttccagtttttgtccattcagtatgatattggccatggggttatcataaagagtgcttattattttgagatatgacccatcaatacctaatttattgagagtttttagcatgaagggctgttgaattttgtcaaaggccttttctgcatctattgagataatcatgtggtttttgtctttggttctgtttatatgctggattacgtttattgatttgtgtatgttgaaccagccttgcatcccagggatgaagcccagttgatcatggtggataagctttttgatgtgctgctggattcagtatgcaagtattttattgaggatttttgcatcagtgttcatcagggatattggtctaaaattctctttttttgttgtgtctttgccaggctttggtatcaggatgatgctggcctcataaaatgagttagggaggattccctctttttcttttgactggaatagtttcagaaggaatggtatcagctcctccttgtacctctggtagaaatcggctgtgaatctgtctagtcctggactttttttggttggtaagctattaattattgcctcaatttcagagcctgttattggtctattcagggattcaacttcttcctggtttactcttgggagactgtatgtgtccaggaatttattcatttcttctagattttctagtttatttgcatagaggtgtttatagtattctctgatggtagtttgtatttctgtgggatcggtggtgatatcccctttatcattttttattgcgtctatttgatccttctctcttttcttctttattagtcttgctagcgctctattaactttgttgatcttttcaaaaaaccagctcctggagtcattgattttttgaagggttttttgtgtctctgtctccttcagttctgctctgatcttagttatttcttgccttctgctagcttttgaatgtgtttgctcttgcttccctagttcttttaattgtgatgttagggtgtcaattttggatctttcctgctttctcttgtgggcatttagtgctataaatttccctctacacactgctttaaatgtgtcccagagatactgctatgttgtgtctttgttcttgttggtttcaaagaacatctttatttctgccttcatttcgttatgtacccagtagtcattcaggagcaggttgttcagtttccatgtagttgagcagttttgagcgagtttcttaatcctgagctctagtttgattgcactgtggtcttagagacagtttgttacaatttctgttcttttacatttgctgaggagagctttacttccaactatgtggtcaattttggaataagtgtgatgtggtgctgagaagaatgtatattctgttgatttggggtggagagttctgtagatgtctattaggtccgcttggtgcagagctgagttcagttcctggatatctttgttaactttctgtctcattgatctgtctaatgttgacagtggggtgttaaagtctctcattattattgtgtgggagtctaagtctctttgtaggtctctaaggacttgctttatgaatctgggtgctcttgtattgggtgcatatatatttaagatagttagctcttcttgttgaattgatccctttaccattatgtaatggccttctttgtctcttttgatctttgttggtttaaagtctgttttatccgagactaggattgcaactcctgccttttttttgttttccatttgcttggtagatcttcctccatccctgtattttgagcctatgtgtgtctgtgcatatgagatgggtctcctgaatatagcacactgatgagtcttgactctttatccaatttgccagtctgtgacttttaagtggagcatttagtccatttacatttaaggttaatattgttatgtgtgaatttgatcctgtcattatgatgttagctggttgttttgctcattagttgatgcagtttcttcctagcatcgatggtctttacaatttggcatgtttttgcagtggctggtacaagttgttcctttccatgttcagtgcttccttcaggcctcttttagggcaggcctggtggtgacaaaatctctcagcatttgcttgtctgtaaaggattttatttctccttcacttacgaagcttagtttggctggatatgaaattctgggttgaaaattctttctttaagaatgttgaatactggcccccactctcttctggcttgaagagtttctgctgagagatccactgttagtctgacgggtttccctttgtgggtaacccgacctttctctctggctacacttaacattttttccttcatttcaactttggtgaatctgacaattatgtgtcttggagttgctcttctcgaggagtatctttgtggcattctctgtatttcctgaatttgaatgttgacctgccttgctaggttggggaagttctctcctggataatatcctgcagagtgttttccaacttgattcaattctccccgtcactttcaggtacaccaatcagaatcttatcaatatcctcatctcccacatgaatattctctgacagttccagcccactctactctctcatcctttcctgaaatgttatggctcttatagcctgtgccacaaaattaggcatttaattttatattgtcttgttttgttttctaattatgtcatggatatattcttttccatgctagattgtgaattcttggcaaggaaccaattttcatgcttttctgtgtctcttttcagcatttagaaaatatggacatataattatactcaataaaaattgttaattgactgaacaactttcctaggttcattgtaactcttcagttctatgacattaaagtacagagcacaaaatggccaacaattcgtatgttaattatctgaaatgatgaaatcattcaatacacctgggcagctatgagaaatgtcgttgatggtgtgagcagtagtggtgcatgcaagggccatccatcctaaacagctctcatacactttgagttttggactgattcatcagttatctaccgagtagattgcttaaaaagaagtgttgggggctgggtgcagtggctagtgcttgtaatcccagcaatttgggaggccaaagcaggtggattgcctaaggtcaggagttcgagtccagtctggcaaacatggtgaaaccccatctctactaaaaacacaaaaaaattagctgggcgtgatggcatgagccagtcatccaagttacttgggaggctgagacaggggaatttcttgaaccagggaggtggaggttgcagtgacagtgagctgaaattgttgcactccaacctgggcaacagaatgagactctgtctcaaaaataaaataaaataaattaaataaataaaaattaaaattaaaaaaagtattgaggttttattgctccatttatttgtgttgtcatcaaccatttggtatccattgcctcgaagtaaatcaaggtgatctaaagggttaatttatgattcttggaaaattctataatgttcgcttatctcatttgaagaaaaagtaaaagttaaaatatttgaagaagttactactcagactataaaaatcatgtagtcttgccttctcattctattctcaaggttctggaagttaaataaaaatggcttattataatgctggtctttttactaactcataagaagttcaaaatatgtagtttttactcctctacctgctagtatttagataagcacctcaaaaccaatattcacgtttcataatcagagtgccctagttaaactccagatttgttacttactagctatgtgactctgagtaaatcatgtaatttctaagagccttcgttgtctttcagataaaataggcaaagccatatctacttctcagtgttcttgcaagaattaattagctcatataataaatgtgcttattactattcaaaaaacatataaaagcataaagagtacattactatttatctgggaataatcctttttattataatgtaataattgttattacaattattataaaactcatctttttgagtagggcatacattattgttcaaaatgtaataaaattggtgaagttttagaactggagcaagatgtcatagtagcgtaaaagagggcacttaacaagacctgggtgccagaaagtatatctaaattagaagatttttaatatgagttttagagattttaaggaagtcattatcagggcttctggagacaaggtggcttgggcacatttatattttagacatatctagcaggagggaacatggttgagcagagggtgatgatgacataaggacaccactgaaaggaatttgagtaaaatgatgacacatattaggagagatggggcagatattactcatttgagaaaaagccacacttcaagagtgactggaaagagtcagggagtgcgggaaaagagtcaaaggtgatccttaagtatctagtttgggtaactaggatagtgtggctccaacctgtcgtaatcagcttgggctgctataacaaacattatgctgagtggtgtaaacagtggaaatttatcttctcagaattctagaggctccaaagtctgagatcataaatgtcagcatggttggattctgttgagggccctcttcttgggttgcaggcagctgccttcttatatcctcatattctcagagagagagagagatcatctctcttgtgcctcttcttataagagcactaattccattcatgaggactctaccctcatgatctaactatctcccaaaggcccacctccaaatatactttggagattaggaacttaacatataaattttgggaagcacgacaattcaccccatagcatacccattgagaagaacaatacaagaaaatttggagttaactaatttgaggagaaaatgatgagtttacattaaatcaagacgaacttgagatgttttaagagggaactgcttcttccctactacttatatgttctgccaggaagagaaaattctgctagtgtggtacttctagtttcttctcttgtccctgtactcactctgcccctggggaggcgaattatttatttggttgttcaaactggggagagtgactcttctgtctagaaacagccttcctatggagagcctgggctgtcctctttcactccatgctttacatctgtaaattctgtaggagcctccctcttggaagccaaattgccccacaatccaggtcagattgtggttcatattagccactgcacttacccttgtttgaaagtcacgtgccccaacttggttatggcttggtctctatccttcctgcttatttttcagctttctcagtgttgaggcaggaatgaaaggtatcctttatagaaaggactctagagattccaacaaggccacttttgacaacacatctatgacccattttttggcatctcacacaattggctcatttaagtttttcaatgtttgagctaattaaaatataaatatgatgtatgttttatatacttccaaaatgtaataaatgctcagtaagtatctgtggagattatatatttaaaattagttgggaaacataactatcctactgttaaacattttttagagagatttagagatattcatttattgaactcctatttggctggtaatttgctcagtgtgacctgccatcctacactttttacaaactgccccacttctcattttgccaaaccagattgcctttctcttaatagctccttctttcttgccactgaacctaaactcatgttctgagcagtaggcaaaataattaacagacccacaaagatgttcttaagtcccagaccctgtgaatatgttatgttacatatcaagggggaattaaggctgtaaatggaattaaggttgctaatcagttgactggaatataaagagattattctggattatccaaatcagttcagtgtaaccataatggttcttataagtgaaaaagggaggcaggagagtcagagtcccagaaggatatgtgataccaggaagcagaggtcaaaatgatgcaactgctagatttgaacacggaagcacccacaagccaagtgatggggatggcctctagaagctgtgaaaggcaaggaaacagactctccttctagaaaagaatgcacattgatgacatctgattttagcttagtgaaacccatttcatatttctgaactgcaaaactgaaagatagtaaatttgtgctgttttaagccacgaggtttgtggcaatttgttgcagcagtaacaggaaacaaatacattctgcaactcatctcctgcattttccctgagtggccatttataaatacatagactctgacccagcctggccagagataaatcaggctcctccacctctccaactgctagctctgtgatcccaggcaagttattaaatttttacatgactatttcctcacctataatatggggattatcatgacaccatccttatagggatgagttaatagatgcaaagtcctttggaaaagtgggcacataacaaacactatagaagtgtacgctaatattttcattattatgcttacctctacaaattattttataaatcagttcaaacgccaattcttctatttccttttggaacaataagatctttcttccttaaatttatagagtactttaccttaacaatattttatagcatgtgttcgttattatgcttacctttacaaattattttataaatcagttcaaatgccaattcttctatttcctttttgaacaataaatttacagagtactttaccttaacaatgttttatagcatgtgatattttaattcttatttaatcactttcatacatattgaatcctctctcctaagatataagatcttgtaaaaattagtgatatgcattttatatatttactttatttattctaattttgttattcctatactgtctaggccagtgttttgcatatcataggtgttcaataaacatatttgaactaccaatggtgttttccacttgtgctaatttcaagaaacaaacaaaatcattcactattcaatgggcaacactctacagaaagaattaataaaacagaagaatgaataaaaacccgaagagtagcatgaagtctatagaaaatatcctccacaagtatgtagtgggattcagattctttttttcactttcactctagatgttcaactttaatttaaataacatgttagatcaagtgtgcttttataaattagttattagcccataaactgtcttatatagtctgctctgaaggttatcactttaagaggcatgatatactgtggggactgaattttagtactgtgcaaagacctgattggaatgaacatttctgaacttctagagcctctccagtaagaatgcagttgttgctgtgaaattgactttaaaagaagcttctgatgacaaggcctagctgattattgtttcagagatgaagtgaaaaaagagcaaacatagttaccatagaaataaatgtattaagttctaaaattaacattcttattagtgattatgcccatatttttttgatacatctacagttaatctcaaaactttcatcatgggtatggggttatacttcctggtatgacccaagatgtgaaactcaattaaggtcaaatgtcattaacttcggtagtatgttttaaaattaacctcaaaacggccccaaattttgttaaaactatagaagaagaaattatttattaagaaggtaagaaaagtaattcttctaaactatgcaatcatttatttattggctctgataagaataacatttcaaatggttgtgttttctgtcagtaatttgaagttctagtataatatttttatttaattacatgattacaaaacaagtctttacttacatcatatgcattatatgccaaattaattctcctttgaaaaggccaattgctgataagagcaatgaattctattgaatagctcactgaattctgagagagtaattaagaaatttttatatacacacagaaacacatgtggctcacacattaagatgtagacgacaatctttcaagataccatctaacaaatggaggaaatatgttttcagcttgcaaacttcaaagctctatgtccaataatgagataaatcttcatttctgatggtactaatccaacactgaaaaattaattctcctttgaaaaggctaattgctgatgatttcgcagaaaagaggtctattctttttagtggatatgaattgatcctgctaatgcagaacctgactttttcagattcctttagcctttagtatgagtgaatttttaaaatttctcttttgttgtgttagaaataaatataatgattttttctcatgctgatttttaagagtttaaaggaaaacaacagctgatagctcattaaggctcatgagacaccactaagcatatacaactcccattttgaggctgcataagccaaacactttcaattccactagaaggtgtcattagaagtacttaagcaaagaaagctactaggagcaagaacaccccagagaatttctgtaaagactttgatgcacccattgtcccatagtttaaaatgttgtatcactcaagcagcaacctcattaacagatcatttagattatcatgagttatgatgaactcaagcctctgtagtattttcttcccaacaatttgctttattacagcaatataacagacatctgccttaaagagaagtcttactttccactctattggatgccactgaaatttacagtgtctggggcaggaggaagaagtaataaagtcttacagggaaaaaaaaaacttgttacctaagggcaatatcagaaatgatgagaaatgagataagccagtaggactaattcaactagaactgaagaagctggctctgaatctgatttgctctcctccaaaagaaaaatatgctcatgataacaataactaatgtgtacttaatacttttgaggaaaatgactatgtggtgctccaaactatgtgcaacattctgtgccaggttattctatctatctatctatctatctatctatctatctatctatctatctaaaatttatgtatacacagaaatataacattttacataagtagtaaagtaactctgtattttaggtcttatcattgccatgttaaatatatttccagagtaatatagtcagtaagttgtttaagtggggtttggatgcaggtctctttggtttcaaaggctgcagtctttacccctcatcatattgccttgcttttgttgccttcttcacttcttttgtctctgtttcttattcagacaaaggtgggaattgactgtaggtgaagactcttctttggctaattggtttattttatccctaaggaagattcctattcttgcttctggtctctcttctccctctctctcttcctctctcttttttttctctccctctttccttccccctcctcagaaaatgactagactttacctttgcaatagactaaatcatagcccctaaaagagatatgcctaggtactaatccctgggagcttatccataaaaaatgtatttgcacacctgatgaaattaaggatcttcaaaggaggttcttgcattggattatccaagtggaccctaggtgaagtcacatgtatccctttaaaagggagggagatctctgtctccctctgggcttctcagtctagagggaggcagatacacacaagagaagaggcaatgagatcactgagtcagagattggagttaggcatccataaaccaaggcattcctggaattaccagaagctggaaggcaaggaatggattgtctcctaaagccattaaaaggaatgtgaccctattggcacctttaattctggcttctggccttcctaactgaagagataataaatatctattgtgttaagccaacaagtttgtggtagtttcttacaatagtcacaggaaactagcacaactctcttctttgaaattctggaattggcggcaggggaaattgcatgtaaaagcactgcatgtttacctctggctctgtgaaatcacaggaagtacagttaaattctaggaaacacaggggcatttttacctctgcacaaatctataaagctcctgagggtcctgcagtctttttccaccctgatgtctcccaagacagccttctgattgctgagatatagcctacattgaatagatatttgttgagcaaatcaacctgcttctgctgtggctccagcaggactggaacatttcaggaaagaataaaaggtcatttctcctgagttaagtgttaattcttgctttgaatgtcagtggcgtgctaacacctgctctcacatgtattttaggtccatcagcgtatcctaactagaaggccttgtgactagcagaaaagaaaatgtaggtgagccatgcaatgatggacgtggactgctctcagggcgcagtgacaattatgacttagtcatcaaaggtgaattgatacaaacacttgaacatatcttaaattagattgttccaggaatccttaaaatgcaagagaaatggcaatgatggggcagtggataaatctaaatgacattacgtgggctatgattcctttctccatgccatttggaaagttagaagaaatcatattaggcctgagaatagactgggtgcttctcagtgtgtatcctttacacccagagtgccaatcatctaggatgcaccggttctgccatactggggatatacagtcaaagtccattcttactagctggtaccttgcaggaccagttgtcaaatatttttaacagcaccttattcatgcatttttttctagaatatatatgaactttttccatccccagtattgtggctcccctcccatccctatttagatcctcatctctcacttggatgcctaaaatagccacttcagcccctctttctacataatcatctcctgtaatttattctcaacacatgttttcttgaagccttatccaaatatatgattcctctactaaatgcatgaatacataaagaaaacaaacatagaataatttactgctactgacttcatgtcattccacaggattaaatatagatcccatattatacacactcatattacacttatataatatctatattattatatatctacattaaatacacatatattctatacattaaaagaccctcacaatttgaaccacattgtatggactcaatgtttgtgccccacccccaaattaatatgctgaagcctaaaccccaatatgatggtatgtggaggtgggatctttgggaggtaattaggtcacaacggaggagctcttatgaatagaattaaagctcttataaaaagagacacaagagagattctctctctctctgccagttggccatatgaggatacatgcagctatcggcaaaccagaaaggccctcattgaaaacccaatcatattggcaccccgatctcacacttccaggcaccaaacctgtgagaaataaatgttggttgttgaagtcattcagtctatatagtattctgttattgcagcctgagctgactaagacacccatctaactctgcagccttctgttcctctctctatactgaagtctatttcattatttcatatgtatttctcatggctttttgaaatcaccagacaatttcctgcctccatggttttagagctgatgtcaaatgggaacaccctggtgacaccaagccaacagatgtcaattctggttggtcaaggctgctgctctatctgattagttggtttgggttaccctaaaggcagatcctgagacaaggaatttcatataaatagtttactaaagacataatctcaggaaggaggagtgagaaaagcatagagactgatacaaggatggaggaaagccaatataaatgtattttgacaaagttactgtgagaaatcagaagttcacacgtatgctaggacatgtgagaagcccacctatgaaatgaccttataatcatccagaaagataaggcatctatccttccatcattggttaggtttgttaactccactgcatttccaggttatactgatgaacaagatgagggaattccaaccacatcactccaggccaggaggctgaatcagaaagataagtaatcgtccatttcctctgctccctcactgtggactggaacgtggatatggtggtggggagccaggttccgtcatgtagatatagtggagcaaaaaagctctaaaaatctggatccctgcatgacctcatggaacagagtagttgtatttttttcatcctaccacccctggagtgcctaacgattctatattgtcaagtgaaaattatttcagtctcattctggtggctaaacccaaatcttaattaatattattctctcatgcatctgtcccatgctgtttactttcactgcactctagttccacttcctgtcagactctattgcaattatctatttaaatgcccatctccatcgttgcattgaaagttcttgatgacagccacggtgccatttctgaaccctgagtgcctggtaggtattggatttacaagaatttttaaataaaatttaaaatgtaattgctccaacagtaaagctgtaatacatgcaattaaaaatatatgatacataatcaccactcactgggctgcttactgtactttttctcatgaagtataatttgacacaggaaggttaatgaagcatttcctgggaaacatactttacatataacatgactccaagatgtgtttgtaccattcttgtattctttccctctgtcacaattagagaggtggttcttctcctagccaagaaaaattcttctatctatgctatagatcttcttttttctcctaccattaagaccctaagctcttttttcgattccttcaagttctttctctctgttggttaaaatctctctaaaacaatcaaagaatgctacctagtcttcacatgttcctttaagtggcagactcttttctttccctctttccctccctccgtccctcccttctttctccctctctttccctctttccctttccttctttctttctttctccctccctcccttccttttccttcctctctctctctctttctttcttttttttttttttgagtcttgctctgtcacccaggctgaagtgcagtggcacgatctcggctcactgcaacctccacctccctgattcaagtgattctcctgctttggcctcccgagtagctggcattacaggcatgcaccaccactgctgggtaatgtgtgtgtgtgtgtgtgtgtgtgtgtgtgtgtgtgtgtgtgtgttttgagacagagtcttgctctgccacccaggctggagttcagtggcatgatctcagctcactgcaacctccacctcttcagttcaagtgattctcctgcctcagcctcccaagtagctggaactacagccatgtgccaccacacctggctaattttttgcatttttagtacagatggggtttcaccgtgttagccaggatagtctcaatcttcctgacctcatgatctgcccacctcagactcacaaagtgctgggattataatttttgtgtttttagtagacatggggtttcatcatgttggcccagttggtctggaactcctgacctcaggtgacccacctgcctcggcctcccaaagtgatgggattacaggcgtgagccactgcacctggccaggtgacagactcttaattatcctgtgggagtcaaggtttcataaaagccttcacttgctgtctgcattttctcactcacttcacaacacaattccaacacaaccaggtttatatcgctcttgccaacatttcacaaaattcaatggacttctgttatcatacatatctgtcagcagcactcaacaccactcaatcctcccttcaaatgtccactgtgtcttcatttctgtttattcttcttttctctccagccactcattctgaatgtattttgctgcctcttattccctcagtagacatttaatgataaaaattctcaacatttatttcaagatacgcttcccttctcactcaatataatgtcgctacttatttttttccaattctatggcttcattggtcatgccacaaatcctaaatgttcatcgcctggacagaccttgcttctgagttccaaaaatgtctattcaaatgtgtactgagatgtctcactggcaactcaaaaccatatgccattgtatctgaaatgttggcccccttcaagactctcaaccaagaaattgcaccataatttacctcattgttgaagccaagaaaatggaaatcttatatgatttctcattctgccaccaagaatggccaaccacactgaattgcctggaactgaggcgtcttgtgggaggtagaacttttaaagctaaaattaagttagttggttaccttccaatctggctcctggctctgtgcattctatttcctaaatatctcttatatttgttcaattatttccattttcatgacctctgctactgtctcttgtacagggatccgtacgttcattcttgcccttcatttctcaccctacaaatgctttctgtacacaatgaccacaagatatcaacaaaaagcaaaacttatgatatcaatctcttccatccttctcattgtctatgagataagacccagcaatatctgggccctgcgtgtctcctcagactcatgattcattatttcctctgtgttccagcccaactaacctttccatttcttaaatgtgccatgaaacaggcctggaattactcttccctactccttcttcctattaactcctcatcttttgggtctcagaatcaatgtaatttcctaaagatgttttgccttctctccctagacaagatcagacacatctttttccccccgcccatatcaaactgcactgttccttcacagaattcaacagcattcattatttgttcaatatccatcttcccagccacactagaaactccatgaagcaactattattgctttattctcttaccactgtatatacaataccccaatcagtgcctagaagcaaaaaacttttgtgaaatgaataaatattttgttatagaatatttccttatgtgatatcatgtcctattataacttcagataggttaactaaaaatataactctattaaggaaagaaataaggccatggcccctcctaaaattttagcaagttttaccatatcccctttgtatggtttggatttgtgtccctgcccaaatcttggattgtattctccaatgttggagtaggggcctggtgggaggtaattagatcatgggggtggacttcccccttgctgttctcatgatagtgagtgagttctcacaagatctggttctttaaaagtgtttagcacctccctctttgctctcttcctccttctctggccgtgtaagatgtgtctgcttctcttgcaccttccaccacgattgtaaatttcctgaggcctccacagccaggcttcctgcacagcttgtaaaactgtgagtcaattaaaactcttttatttataaattatccagtctcaggttgttctttacagcaatgtgagaatgaactaatacagcactgaatctaagatgtcatcaatggtaacgtgtcattattttaagtataactaagaaagaaaaacaatgttgaaaaataagtcatgaaacaccttgactgaaagacacatccagttttcagatatcaaaaagtaaaaaactgggaaaggccacaacttccacaacaaatcttgtttgctcacttctctctctactgggtggtccctccttggtccatggagtatcacctcattcttgggccattgcaacttccttgtattctcctaactagtatcttctcttgtatacttgaacccccagcttctttacatttcaaccagactgatcatttcacaatacaaacctgatcaccccaaaatgcaaagcctgatctctggataaccctatactggttgtctattctatgacacatcacacacatactctcccttgttttctgtcttcctgacatggttcctaaaatatgccagcttctttcctttatctggaatattctgcgacttgctgtcttcaatcgttccttctgctccttttcattttatagtgttcattacaaatttccccttcccagaacgatgttctgtgattctgtcactgcaaatcagtagcccctctcccctgcccatgccgttagaatttttcacacgtatagcctgttctcttccctcaccgagctcatctcaagttctcattacacatatttttttgtgtgtttatttgcataacgactgttgcttccactgaactttgagctccataagggtaactatcagcatgatgtgccagtgccatataccacagtgtgacacagatagattatttattgaatgaatgaggaagtggaacagttacactttgctgaaacaaagacaatagaaaattcaatgcacagccctgagaggaatctagaaacaagtctgcagctaaaaagaagcagcatatacccccaaaacttaggtaggtgtcataaccacatcctcataaccatgtgtgttctcaccagatacacctgccttctaaagactgtttaaaaacaattcacactaaaggtactacttaagaaaaataggcccttccatcttaaaagagaaaagtttttatgtattgcattgtatgttcctctcaaatattttaaaattattttaagtcacagattgtttcataaacataattttgtttttccaataaaaagctttgaaaaaactcagaaaatatttttgcaaatgtggacctcaatatcatttgttatgtctcattttgaaaaataatcaaatttgaaataaaatgtgttttagaaggttagaaatatacacatattttctcttcacacgtttgtgaaaaaaattaggtaaatgactaatgagaaaatactactagactaaatttacaaagaatacagagcaaaaacagaacaatcttaatagaatcagtgccaattacatctcacatttcaatggcagtgaaaataaatgtgattttgacatatgaaattgtgttaggaatgtttttatgtagaggaaaatgttatcatccttgggggctttttgttcaaccaattttcaactttctaatgcctggctgtgccttgtgtggaatcagggaagtcactatttctctgtccttgaatactgctcatgcatcattctcataaaaatatatatttgcccatccctgaattcatgtgtctcttcattcactcagcatttatggagaaaattttatatgacaagcacttggctagcttctgtatatacaaagatgaataattctaggattaaaatatggcaggaaaaataaaaccattaacaagtaaattctgaaagttaaatgctaataaaaaagcagtagacatatgtacaaatattgaatgccattttatatctctcttcattttccagagaagggcattaaggcttaagataacaaggtaatttcatggagatttcatacctaacgaatgaaaagactagggcttgaattctggtttctcatttcataactagtaaatccctttaccgagtgttgtcaaacatatgtcatccattttatgtatgaaatctcctttcatactatgcatcttcaccagtttgagctgctataacaaaataccatagactgggtaccttataaacaacagaaatttatttctcacagctctggaggctggaagtccaaaatctgtgccagcatggtcaggttccagtgagagccctatttcatgtcacagactgctgacttctcattatatcctcacatgaggaaagagcaagagaactctgtggagttccttttataaagacaccaatccattcatgagcactccaccctcaagacctgattacctcctacagaccccacctcctagtattatcacattgaaggtttgatttcaacatacgcattttgaggggaaaccaacattcagtccataagaccatgaaaaataacaatttttatttctgttatactgacaaggaaaccaagactcagataggctcagcaactggccaagccacacagttagtaaatggcagcaccaaaattcaaactcaagtttgtccaacccagaaacttctgcaatgtctactatcacgagcttcctctctattccagttcccatgtatctgtgaaatgatttaattatcacacattactagcatttgttgagcatttatatgtcccaagcattccttaaagatgcttccaagaatcaagttatttaattccaaaaaaaataatatgtaggtactgaggtaccatcctaaggtattgaggtattatcctgatagcacaccgagaatgctatcgggtctcccaaagatggagaattaaagaacgaatgtctctatattcctcagcaggagtcagtctaaaaggaataatccaccagccagagtatatgccatttttagattacagatacaatccactataagttccaaacccagagtggtcaatattgcttttcttcttttatatctgttctgttttgcaaaatatatgttatggttaaagaatgaacttgagtgagctgccctgaaatgagagccatttgtttaaagttctgtggtgactccttcttccttcccacctgcatccccaaccacatgttgagattcctggaaatatgctccttcataagggtagagagccaatgaggaccaaatgatatgttttcctttccctcagcttcaagggctcaaagtcccagatgaggggcagggagcatactccatgacagaaataaacaaacagccaggtggcccaagtaatgactagccaggtctctggaaactcctcaagaactcaccggcttgcagcctaatctgggaacagtgttgtacatgactacatataatataatgtgaatagtactactacagacaggtggaccaacatgatctgaaagcaccagttaagaacacatacagaagtatttgatacaaggtaaaatctatcattcaaaggcatacaagtactttgcaactacgaaacacctctaaaaaactaacggctttgagacagtgctatacataaagataaataatttaaaagactatatgtacattctcaaaagtttgtccttgcacaaatcacttgcttcccaccataaacacttctgagacccttcctaataaaaccattaaggttgagcaggcaacattgtttagaagaacaactgtgagttgtacatgacccttcataaaagcagagactactaaacatcattagtaggcgatattacagcatcttcaaacccagacataactggcaccaaatttgcaggaaaatgagttaccttcctaatagcccttaattacaattacaatgtgactttactcgtattccagtaatgaaagcatttactctcattcctcatctgatttaaagggcaacataagctgaatgcaagataccttataaaattagaaaagcaattgaacaaactttaacactgtgccccaggatgacaagaaggaaacttcttcagaaacaagacatcagtgtatccaaaaagttctttggatttcacagtttgtaatcccagggaaagaaatatggaaaaaaaaattgagaactcagttatttggccaagctaaatcaaacacatgtttataaatctaatttctatttcttagagataccgagttacagatactatatgggctaatgataacgaagatgacaaaacttctttttagtaaaaaataaccattagctataaaaattagaaaatagagaccagtgaaatataaattgagaatagggtataatggatattacaacaattaaaagaaaaaaagctggccaggcacgttggctgacgcctgtaatcctagcactttgggaggccacggcgggaggatcacaaggtgaggagatcgagaccatcctgactaacacggttaaaccccatctctactaaaaatacaaaaaattagccaggcgtggtggcgggcgcctgtagtcccagctactcaggaggctgaggcaggagaatggggtgaacccgggaggcagagcttgcagtgagccaagatcacgccactgtactccagcctgggcgacagagcaagactccgtctcaaaaaaaaaagaaaaaagcttattaaataatttaatttagtgctataccttataaaacattgtaaaagaaattccaaatcaaaatgttatttaaaaacaataaataacccctctagttcaaaacagaactaaatatttatgaactttttagaggaatagtgcttttctgcatcaaagaagtgacaacaaaggtagtggcagattcaacacagaaaaattacaacttcctcatacaatgaaaattttacctaaagcaaagaagggattaacatctaatatgacaaaatgttaagatctgaattgtacacaaagtgcacagaaattgataaggagaagctctggtgacggctagaagattgccagagatgtgaaccatgtgtgggaaagctcgactgggaggataatataaaacaagaggaaagaaaagtcagatttagagtgagaacattgtcaataagaattgccagggtcccctagatggttccaatgagcctcgtctcctgataatcacatccttgtgggagggggtctcacattgacttgtgtaaccaatatgttactgcagaaatgaagttatatgacttctgaggctaggttaggaaagattttgcaacttctgccgtgtcttttcttgtatcacttgctctggggaaaggcagctgccacattgtgaggaaactcaagcagccctatggagaggtcaatataaaaataactgaaacattctgagaactgaagcctacatctacttgattattgtacaaaggaagaaattgaggcacagagattaagagccttgcccaagtttacacaggaaggaagtgccagatctaagatcaggtttccagagcctgagtccttaacctttacatgatactgccttctccatggtagaaatagaatgaaaaaatgtttacaattgtatgaaacataacaacaaaaaagaaatgctaaaattcagaaactgattggatgtgaaggcaaggggtgcattgaaatggctttagtttttcaaatatggataacaaggagaacagtagggttattaattaagataaagatcagacactcacagtttgaaaagtaaaatgtgcacataaatgtatgcatgtgtgatcattcatgttgtttagagagtaaagtgatacacagggaatgtagtgagcaagctggtttgggattatcagatttgagcttgcccaggcaagaagaatttcagagaagcttcattccactagcatatattaaaagatggcctctttcaaatgataatgtgtatactactttccttctggagattcataaaacgttggaaatttcctcactccacttaacctcttttttgcccgtctcattcttatcagtcactctaggcatggatctaatctaaattatttttaaaatatgactctttaaaaacacatactaattaagtagaattcaataaaattagtttatttaaaacatgaatgaaataaaaataattagactcgttttgcaataactagaatataaactactatgcagagtgcaaatgctatgtttcattagtgtgtaagagaatattctaagtttgagaagtgttttatttctctaaaattagaaaaattttagtttttctttagtttttcttctcccaaacatatgtgactttatttcattttaatatataagtctttttaataaatacatttctgtctatggggagctcggaaaaggcaggtgcagcaggtgttatttttgaagagttctgtacacgttcacatctgcttagttgttatgcactgctgcatgtaatggccaagaaaatccaacacaaatgctgaaaccaaaatccccaggaaaccagcagaaacgaaattggacaaatcctaatacataatgtatatacttcaatatcctattgcatgtggttacaaatttgaatatggcatatagcttatctttgtattttactaaaataaaactaaaacccacaaactatctggggagattaaatttaccgtacataaaaatgcccaagggaatgctgcattccttttatgatagagggactaggcaatgaccagagcggtgcaattaaccagactgttggtcatgagttgatattattgttccactagccccacttgattcactgccaagctcatcccataccctcatttgttagagccactccatctttgctctatttcacttgcatagaaaaaaaattcagatcctgaaaatcaatatgttgttgaattctaattttgtcttattttacttgcagatcttatctcacttgcagctgtttacattttccatattgtgttaatagtcaaattttatttctaaacataacctaatttttgctgtgcaggtaacaggctgtttaacaagctatacctactttagggtccttcagtttttttattctgtttgactatgtaatgtcttcatcaaatatctcctcatttgaacatcaaaaatattattttttattatagcaaccaccaagtatcatgatacaaagcactaaagttggttcttcgagaattattttgaaaatagctcttttaaatgtagaaaataaatttccttgtgtttcttattttatatactaaatatattcatttacaatatatatttggttttcacttcatatgttcttgcctcctttgaataattttaatttaaagagaagacacaatttccaaatgtttaataaagcctcttagaattatacttcatgcaatagataaatagctatgatacctgatcagaaaatctcatgagcagtaatgactgaggagggctcctgaaggatgctatgtctccgtatccttccacttccccaaatatacaattaatttaaagctggacagacaatgggacaaagtttcagccattaaactccaaatccctcaaaatttaaaaacaaaaaaatttatcaacaaaacaaatagcacattttaaaatttaaaactaacttaatatatgactatacaacccaccaattccatttctagctatcttccccaaagaaatgaaaacatacattcacaccaagacatgtacagagatgttcatagcaactttattcacaatagccaaaaagtggaaacaggccaaatgtccatcagtgagtgaatggataaacaaaatgtgtcatagccatacaacagaacattactcggcagttataaaaaaggacaaagatacatactataacattagtgaaactcaatcatgttatgcttggtgaaagaagccagacacaaaagaccacatacaaagatatcattttttattttgtttcattttattgtgccttgcagataccacattttttttacaaactaaagatttttggcaaccctgcatggagcaagtctataggagtcaatgggagtcattctgaacagcatgtgctcatttaaagtctcagtgtcacattttggtaattattacaatatttacaactttttcactattattacatctgtcttggtgatctgcgatcagtgatctttgatgtggctaccatcattgtttggggcaccataaaccacactcagataacatgttgaacttaataataaatgtgtgtgtgtgttgactgctccacagaccagacattctccatctctctccctctcccccagcttccatattccctgagaaaaaacattattgaaattagaccaattaataatgctacaatggcctgtaaatgtttaagggcaaggaagaaccacccgtcttttagtttaaatcaaatgctagaaatggttaagtttagtaaggaatgcatactgaaagccaagataggccaaaagctaggactcttgggccaaacaggtagccaagttgtgaatgcaaaggaagagttcttgaagaaaattaaaagtgctactccagcaaatacaccaatgataagaaactgaaacaatcttattgctgatataaaggaagttttagggctctgggtaaaagttcaaactagccacgatattcccttaagccaaagtcaaatccagaataaagtgactttcttcacttctatgaaggctaagagaaacaaggaagctacagaagaaaagtttgaagctaacagtggttgattaaggaaagaagttgtctccataatataagaagcagcaaatgctgatgtagaagttgtagcaagttacccagaagatctagctaagaaaattgatggagggggctgcattaaataatagattttcaaggtagaccaaatggtcttttattggaagaaaatgttatctaggactttcatagctgtggagaagtcaatgtctggcttcaaagtttcaaagtacaggttgactcctttgttaggggctaatacagctggtgactttaaattgaagccgatactcatttaccatttgagaaatcctagtgtccctaagaattatgctaaacttactgtgtttgtcctgtttcccataggtgcaacaacaaagcctgaataacagtacatctgtttacaatgtgacttactgaatatgttaagcctgctgttgggaactactgttcagaaaaaaaaagattcttttcaaaatattactgcttatggacaatacacctggtcattcaagagctctgatgaaaacatataaggagattaatgttgttttcacacctgctaacacagcatccattctgtagctcatggatcaatgaataattttgattttctcatgtaattatttaatacaaggacagacacttctcaaaagaagacatttatgtggccaacaaacatatgaaaaaaagctcaacatcactgatcattagagaaatgcaaatcaaaaccacaatgagataccatttaacatcagtcagaatggcaattattaaaaagtcaaaaaccaacagacactgacgaggctgcagagaaaaaggaacgcttttgcactattggtgggagtgtaaattacttcagccattgtggaagacagtgtggtaaatcctcaaagatctagacgcagaaatatcatttgactcagcaatcccatcactgggtatatgcccaaagaaatataaatcattctattataaaaatacatgcacacacatgttaattgcagcactattcacaatagcaaagacatgaaatcaacccaaatgtccatcaatgatagactgaataaagaaaatgtggtacatataaaccatggaatactatgcagccataaaaatgaataagatcatgccctttgcacggatggagctggaagatgttatcctcagcaaactaatgcaggaacagaaaaccaaacaccgcatgttctcacttttatgtgggagctgaatgatgagaacacatggacacatcggggggaacaacacacactggggcttgtcaaggaggtgggggaagggagaacatcaggaaaaatagctaatggatgctgagcttaatacctaggtgatgggttgatctgtgcagcaaaccaacatggcacacgtttacctatgtaacaaacccacatatcccgcacatataccatggaacttaaaaaagttgaggggaacaaaagaaaaaagaaagaaataaatttcttaatgttatagctgccatgaaaagtgagtcctctgatggatctgggaaaagtaaactgaaaatcttctggaaaggattcaccattctagatccaattaagaatgttcataattcatgggagaaggtcaaaataacactaattggagtttggaagatgttgattccaacccttgtgaatgactttgaagggttcaatagtttagtggaggaaggaactgcaaatgtggtagaaataacaagagaactagaattagaagtcgagcctgaatatgtgactgaatatgttactgagtttgatcaatctcatgatcaaactacaatggatgagaagtttcttcttctggatgagcaagaaaattgccttcttgagatggaatctacctctggtgaagatgcagcaaacattgttgaagtgactacaaaggattttgaatattacacaaacttcgataaagcagaagaagggttttgagagtcgactccaattttaaaagttctattgcaagtaaaatgttatcagacagcattgcatgcaacggaaaaatcttttgggaaagagtcagtggggaaacaaatttcactgtggttttaagaaattgccacagccttggctgggcacggtggctcacacctataatcccagcactttgggaggccaagccgggcagattacttgaggtcaggagttcaagaccagcctggctaacatggtgaaactctgtctctatcaaaaaatacaaaaaattagcagggcgtgctggtatgtacctgtagacccagttacttgggagactgaggtgggagaatcacttgaacctgggaggcagaggttgcagtgagccgagattgcactactgcatttcagcctgggtgacagagtgagatgctgtctcaaaaaaataaataaataaaaataaattgccacagccacacaaccttcagcaaccatccctgatcagccagcagccatccacactgagatcaggccctccattagcaaaaagattatgacttgctgaaggctcagatgatcatcagcatttttttggcaatcaagtattttaaaaattaaggtgtgtacattgtttttttagacataatactattgcatatttaataggcaacaatatagtttaaacacaacttttaaatgcattgggaaaccaaaaacttcttgtgactatatttattgcagtcatcaggagctgaacctgcaatatgttcagttcaataggtatgttgttttgtatgattgtttgtgtgtgtatgtgaagaatctgtgtatttattgatttatcacctaaaaccttcttaaaattttatctattgagggggtacaagatttcttacatgcacatattgcgtagtggtgaagcctgggcttttagtaaacccattacctagacagtgaacattgtgcctaataagtaatttttcaaccctcatgcccctgccatcctcccacctactgaagtttccagtgtgtattattgcgctgtatatgtccatctgtacgcattgttcagctcccacttataagtgagaatatgtggtatttgacttgctgggttatttcacttaggataatggcctccaggtctctccatgttgcttgcaaaatacatgattccattcttttttatgcatgagtagtatttcatgttgcatataaattttatatatatatcatttctttatatataacaaaaatgtatataaatgcataaatatgtttgtgtgggtgtatacacacatacacacacaccacattttcttccattgatggacacttaggttgattccaaatctttgtgactgtgaatagtgctgcaataaacataagagtgcaagtatatattcttttatttatataaaatatccaaagaagggcagatatgtagagacagaaagcagatgagtggttgcatagtggtggagagtgtcaatgggagtgactatatgcacatgagatttcttttgaagctgatgaaaatgttctattattagtgtgcggtaagagctagataaattatacacttaaaacacgtgagctttatggtatataaattttattgcagtaaagctattaaaaacaaatggcatacactatcataaagctaatattactatgtttattgaaaacctattatctatagacaacacatgactcagattacagagggaacaggtcttaaacatagaaactatgatttaagtgtatgctgatctctaaatgactgacattagctcctttttttgagatgtttcatgggagaaaatgtatagaaagctaagagaggtggaaagatggagacacaaaagaagaggacagggtcaggaggcccaagtgtacctaaatcacaagaatgagcctggtgattcaccctgcaatcctttgcctttagagaccctcttggataggaattaggaagcatctccagaagggaaggtgacaaagacaatgtaatacgatgtaggttttttagtgattctctttcaactattgtgtctagtatttggaaaacattagaaaaaagttttagctatacatcattattttatatgttgtatttgctgatacagagattcaaatcagttgggtgactggtgatcagtagatgctcaataaatatttgtccaatagaagaatgaaagaacaattatgctatccataaattacaatattaaatatccatgagctatataattcaagggcaatggggcattggctgtgagagaaaattgtggaagaaaagcagatttgggatagggttagaagataatgaggccagccttggacataatgaacttaagcagagctcgtcccattgacatagaaccatctggaatgcatctcaatatatggttctggattgaggatataaattaggaagttttcagcatagctgaagtcatggaagtctgtgacatataaatcaataatgaatcaatttattttaattgatatacaaaatatttccatgtaattaattctgtctataattctgtattttttggctctgatggtaaatctgaataagtctattaaaatcttcagacattatacattttctttgagaacaacagtggctgtaaacaaagctgcctttgttggcttataaagaacatttgctgttcccacaaattacttttaatgatgcaaaagtccctctgtgacagagacttgttctgtggttatgcatttccctttctaatttcactttgtttcctttctggggtatactccttttgagacacccagagtctgaaaaatgtgagtcaaaccacagattggctggtaggaaaaaaagaaaatagttcatttcccctcttattaaatgtttattcttgttatatataaactcacttgctcttgctatgtggcattacaatattagttttactggtagggcttttaaaatactatcaatcaaatggggtgatagatatattatggggaacagaaccctgatttggagttaaaagaacttttatttaaataacagcttttccatttaccaactttgtgatcttgggtaaactgtaaggtttctctgagattcagtttcttgatccatcaaagttaagtaaatttatgtttctagtaggtttttcatgataattacatgacattatatatataacatatataatatataatataaaatatatataatatataatatacatataatatatataatatataagatatatatattttatatatatatctccaatatctaaatagactggttgctgactttatcattagttgatggttgacagaattatatacatttattttaattatatcattatttttcatatctaataaaaacttaaatcagtggagactttattcaaatatacttcccataaaattcaatgtagcgaagtttttggagcattttttactttattttattttattattattatactttaagttttagggtacatgtgcacaatgtgcaggttagttacatacgtatacatgtgccatgctagtgtgctgcaccaattaactcttcatttagcattaggtatatctcctaatgctatccctcccccctccccccaccacacaacaggccccagagtgtgatgttccccttcctgtgtccatgtgttctcattgttcaattcccacctatgagtgagaacatgcggtgtttggttttttgtccttgcgatagtttactgagaatgatgacttccaatttcatccatgtccctacgaaggacatgaactcatcattttttatggctgcatagtattccatggtgtacatgggccacattttcttaatccagtctatcattgttggacatttgggttggttccaagtctttgctattgtgaatagtgcctcaataaacatacatgtccttgtctctttatagcagcatgatttatagtcccttgggtatatgcccagtaatgggatggctgggtcaaatggtatttctagttctagatccctaaggaatcgccacactgtcttccacaatggttgaaatggttgaactagtttacagtcccaccaacagtataaaagtgttcctatttctccacatcctctccagcacctgttttttcctgacattttaatgatcgccattctaactggtgtgagatggtatctcattgtggttttgatttgcatttctctcatggccagtgatgatgaacattttttcatgtgtctgttggctgcacaaatgtcttcttttgagaagtgtctgttcatatccttcatccactttttgatggggttgtttgtttttttcttgtaaatttgtttaagttctttgtagattctggatattagccctttgtcagatgagtagattgcaaaaattttctcccattctataggttgcctgttcactctgatggtagtttcttttgctgtgcagaagctctttagtttaattagatcccatttgtcaattttggcttttgttgccattacttttggtgttttaaacatgaagtccttgcccatgtgtatgtcctgaatattattgcctatgttttcttctagggtttttatggttttagctctaacatataagtctttaatccacctttaattaatttttgtataaggtgtaaggaagggatccagtttcagctttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtaccatgctgttttagttgctgtagccttgtagtatagtctgaagtcaggtagcgtgatgcttccagctttgttcttttggcttaggattgacttggcaatgtggtctcttttttggttccatatgaaccttaaagtagtttttttccaattctgtgaagaaagtcattggtagcttgatggggatggcattgaatctataaattaccttgggcagtatggccattttcatgatattgattcttcctacccatgagcatggaatgttcttccatttctttgtatccttttttatttcattgagcagtggtttgcagttctccttgaagaggtccttcacgtcccttgtaagttggattcctaggtattttattctctttgaagcaattgtgaatgggaattcactcaggatttggctctctgtttgtctgttattggtgtataagaatgcttgtgatttttgcacatcaattttgtatcctgagatttgctgaagttgcttatcagctgaaggagattttgggctgagacaatggggttttctagatatacaatcatgtcatctgcaaacagggacaacttgacttcctcttttcctaattgaataccatttatttccttctcctgcctaattgccctggccagaacttccaacactatgttgaataggagtggtgggagagggtatccctgtcttgtgccagttttcaaatggaaggcttccagtttttgcccattcagtatgatattggctgtgggtttgtcatagatagctcttattattttgagatacgtcccatcaatacctaatttattgagagtttttagcatgaagggttgttgaattttgtccaaggccttttctgcatctattgagataatcatgtagtttttgtctttggttctgtttatatgctggattacatttattgatttgcatatattgaaccagccttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcctggctttggtatcaggatgacgctggcctcataaaatgagttagggaggattccctctttttctattgattggaatagtttcagaaggaatggtaccagttcctccttgtgcctctggtagaattcggctgtgaatccatctggtcctggactctttggttggtaagctattgattattgccacaatttcagagcctcttattgatctattcagagattcagcctcttcctcgtttagtcttgggaggagggtgtatgtgtcgaggaatttatccatttcttctagattttctagtttatttgcgtaaggatgtttgtagtattctctgatggtagtttgtatttctgtgggatcggtggtgatatcccctttatcattttttatcgcatctatttgattcttctctcttttattctttattagtcttgctagcagtctatcaattttgttgatcctttcacaaaaccagctcctggattcattaattttttgaagggttttttgtgtctctatttccttcaggtctgctctgattttagttatttcctgccttctgctagcgtttgaatgtgtttgctcttgcttttctagttcttttaattgtaacgttagggtgtcagttttggatctttcctgctttctcttgtgggcatttagtgctataaatttccctctacacactgctttgaatgtgtcccagagattctggtatgttgtgtcttttttctcgttggtgtcaaagaatatctttatttctgccttcatttcgttatgtacccagtagtcattcaggaacaggttgttcagtttccatgtagttgagcagttttgagtgagtttcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatcctttttaactttctgtctcattgatctgtctaatgttgacagtggggtgttaaagtctcccatttttattgtgtgggagtctaagtctctttgtaggtcactcaggacttgctttatgaatctgggtgctcctgtattgggtgcctctatatttaggatagttagctcttcttgttgaattgatccctttaccattatgtaatgaccttctttgtctcttttgatctttgctggtttaaagtctgttttatcagaaactaggattgcaacccctgccttttttttgttttccatttgctcggtagattttcctccatccttttattttgagcctatgtgtgtctctgcacatgagatgggtttcctgaatacagcacactgatgggtcttgactctttatccaatttgccagtctatgtcttttaattggagcatttagtccatttacatttaaagttaatattgttatgtatgaatttgatcctgtcattaagatgttagctggttattttgctcattagttgatgcagtttcttcctagcctcgacggtctttacaatttggcatgatgttgcagtggctggtaccagttgatcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttaaaaattctctcctttaaaaatgttgaatattgccccccactctcttctggcttgtagagtttctgccgagaaatctgctgttagtctgatgggcttccctttgtgggtaacccgaccctttctctctggctgcccttaacattttttccttcatttcaacttcagtgaatctgacaattatgtgtcttggagttgctcttcttgaggagtatctttgtggcgttctctgtatttcctgtatctgaatattggcctgccttgctagatttgggaagttctcctggataatatcctgcagagtgttttccaacttggttccattctccccgtcactttcaggtacaccaatcagacgtagatttggtcttttcacgtagtcccatatttcttggaggctttgctcgtttctttttattttttctctaaacttcccttctcgcttcatttcattcatttcatcttccatcactgataccctttcttccagttgatcgcatcggctcctgaggcttctgcattcttcacgtagttctcgagccttggctttcacctccatcagctcctttaagcacttctgtgtattggttattctagttatacattcgtctaaatttttttcaaagtttttaacttctttgcctttggtttgaatttcctcctgtagctcggagtagtttgatcatctgaagccatcttctctcaacttatcaaagtcattctccatccagctttgttccattgctggtgaggaactgcgttcctttggaggaggagaggcactctgctttttagagtttccagttcttctgctctgttttttccccatctttgtggttttatctacttttggtctttgatgatggtgatgtacagatgggtttttggtgtggatgtcctttctgtttgttggttttccttctgacagacaggaccctcagctgcaggtctgttggagttttctagaggtccactccagaccctgtttgcctgggtaacagcagtggtggctgcagaacagcggattttcgtgaaccacgaatgctgctgtctgatcattcctctggaagttttgtctcagaggagtacccagccgtgtgaggtgtcagtctgcccctactggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctaggcaatggcaggcgcccctcccccagcctcgctgctgccttgcagtttgatctcagactgctgtgctagcaatcagtgagactccttgggtgtaggaccctctgagccaggtgcgggatataatctcctggtgtgccgttttttaagcccgtcagaaaagcacagtattagggtgggagtgacccgattttccaggtgccgtctgtcacccctttctttgactaggaaagggaattccctgaccccttgcgcttcccgagtgaggcaatgcctggccctgctttggctcgcgcatggtgcgctgcacccactgtcctgcacccactgtctggcactccctagtgagacgaacctggtacctcagatggaaatgcagaaatcacccgtcttctgcatgactcacgctgggagctgtagaccggagctgttcctatttggccatcttggctgccctcccgtatatggagcattttgaaatataatttttcctaccatattctttgtgtatttcctctaattttcccttcttttgatcttagatgcttttagaaagtctctctttgcttacttgaaactactctttcctaaagtaagaaagaacttaaattttcaaagaaaaaatgtatatataaggtaaatagatattattgttcatactcctatattattatttgaaatacacaaatttgttgttagggatgacaccaagccttctgaaccctcatcaggtcttctagaacaattgcctgctctactattaactatgttgcttgagatcaaatatttaaccctttggtgccatctctaaagtaatcagattagaaattagatctccagcagtttataagttgttgcacttttttgaggattttagatttaggactttcattttaatgatacaaaataaacaattaaaagcatactctgcattgttaggatgaccacttgagtatgacctctgatttcaatgtttatgatcatgtaggtgggtttacttcacttgctagaggctaatgaggaaagaaaaaaacagacacatataaatgaagcttccacagcaaggagggccaaatggtgctgtggctcactagaccaatgagggttttgcagaaacttaaaagaaaaatactgagagaattaagttaacacataatctatgggagtcatcgtgtcaaacttgtgcttactcttagcagttagtgctatagtattctattacattagtgccagttatttcagacttctctggctttttaattttgtttatatttcatttgtgctataaatggaatgtttgtattcctccaacgtttttgttgttgttgtgtgtttgtttgttttttgttaaaacctaatccctaatttgatggcattaggaggtgagggtctttgagaggcaattaggtcatggaataagtacccttatacaggaaatgtgagagctctctctctccttccaccatgtgaggacacaacaaaaagttggttgcctgtggatcatgacgcaggcccttaccagaccctgaatcttcgagtgtctcaatattggacttcctacagaccagaaccgtgagaaatacatttctgttgtttataagccactcagtctatgccattttgttattacaaccctaacagccaaggacatttataaataagttttaggcttcttggttgttaaagatctgtaaacatagagtgttttatgttttctctctatacaaatttaaatagaattttaatgagtacaattttatattttatattctagagaacgttttcctttgaaaagaggtctgtgcttcattgaagtttgagaaatattgaataaaatcttgatttattaatcagttctgtttttcattcccagcatttcattatccctggatgtttccctgctttcaacagtcgccaaggaagagagaacataggagaaagagagaacgaaagaattgatccttggctttgagtttcaaatggcacaggctctgacgcgacaaaagattaagcagaaaatattatcagggaaatgtttatctgcactttacccttatcctcagacatggtcaagattccacaggactaaattcaaaagtaggaagtaagggagcaatagaaatcccaaacagatttagagagtcaggtataggaagaatgtggcaaccatctccaagtaaaacccaggaagtaggcaatcctttgaagtccttctcatctagaacaggtaggaacagaaaaagtctcctgcctgaggttgcaggcagactggcctgcctcagtctctcagtttcccaaactcagcgtggcactagaaaaattcagtgatgccccaaagaggctctaaggataggtttattacagcccatcatgggatcaggagtagcagaatgcttcctgtggacgctgccttggagtaggggtcaggggtggctcagagtgctgccgaccagaagagttattgcaggcaggaatgaacaggacagggtggagacagtgcggagaaatgatggagacccagacatgacccacgtcatgcccacccatgtccatatagtcctgccaggtcctggcactacataagctgcatggagaagggaaaagaggaacatgctaatccagtggaatcaggcttctgatacctagtgcaatgatagagcaaaacagaaatgaggtttacttgcataaaaataacatcaaaacaaacaacaacaaatctatcctttctctgtatctatctatctatctatctatctatctatctatctatctatctatcatctatatcatctatctatctacctgaagttgtagtgggtgagaatcattaggactctaagatcatagtcaagtttaagataatgtctatccttaagaatggaacttgaaaggttagcatgtactaggaaaaatgcagcaacttgaggaacccaaagatcaatatttttaaggatctatcttcaggatctatctagctctaaccatttctgaaatttctgcagcgttggacttttgggtcttgatgttgataataccaagcaatcatcatgatcgagtcctactgtagaagcaaagtggagcccacttgtccactgatccccactttgtatgcggatggagtttgggccaaaaatcggaggtccagacctctgatgtcttccgagtaaagctaagcttttgtgccattttggagatagtaacatgcaaagatgggctgccagccacaataagatgaaaataacgagaaatagattttgtgtacaatcaagaagtctccaagtagagtgtcaatgctgtgattcttgatactgactgtctactggtaaatggttcctgggtcacttatatttgaatcagggccacctggctcttgggcagatgagttgtggcactaaacttcagaaagctgatccactgctcagtcatctgggaaaactgaggcagcctaccaggcccctaaatataatctgtagtgtatttgtcttaaattgattagaaaaacagaaaatggaaggttgtttccatactcatctggcttctaggattgatataactatttttcccttttttttttctccaatagccagggaggaaaaatccagtctcatcccactgatattaagatagccaaccttctagtgttttagagatcagattgtattcgctttctagtttttctaagattgtaaacccttagtagaaagtcttctacacctgatgtttttctatacacaatgtcaatacttagtacataaatataagatttttgatacatttgacaattcctattctgctgagtccaaatttccgggaatgtctgataatgtacagagaagctacaattacagcagggagatgaggcttgatgactacccaagggtacgagaagctttgcagaaggcaatggaacaatctagtttggggcaggactgccaagaaacaagttctttcaaaagtaacaaagaaaatctcatcaaattggatttcacacagacataaggctgtaattcagctgaggcaaacagcagggaaaatcattttcttgtccacttcaagtaacaaaatgattcccctcctgtcacttctgagttgattttgttcttttgccttcgaaagctgaatgaaatataaaggagaggttgtgcatctatctataagtttaaaaaaaaaaaaaaaaaaaaaaaaaggaaagctatactcagtgggaaaaatggaaagaaacagttgagttagtatctctgggacttaatctagaataaggattccaaaaatcacaatttggtctgctgttgggggagagattgttccccatgtcttccttaagcaccaaaaacaattacacagctccagcccatgtgcaagcattagcaactattctgggattgaatccaaatttgagcatgtgtaatagatgaggattttccacaatgtggaatatttgaacagataacatcagaactaacagttaatttattttttaagtaaagaagaaacaaaccataaaaacacaaggcgtttcttgctaaggttcagagacatattcagtgaaatacgcaaataccttaacaagaaataggtgacatttgacttaactctaatacaccataattagtttctttctccatcaaaaatcaaagttagtgtattttgatctaaagctagaattgagatttctctgctttttcttttggctggtcatatgaatcatgcttaaaatgggaaagccagagggtttgatgtggtccagacctatccgtagcctgtttcctatccctgattcagtcttatcagagctgtcccataatctgtacaactacccatacagcttcagaatatgataaagaaaatagacagaggttcttacatacagaaataaggcctcctcttttgtctctccctgcagagattctacaaatctttgagccaaggagattatcaaaatgactcacttttaaacaaacaaacaaacatagctcaccagtgttttttagaatgcaagaaaaaacacaaattggaaccaagaaaaatctgttaattgcttagattctttatttcccttttatgtttactgccactaattagtctggattatccaggggcctaaataaaatagtacgatctaaaaatgcatgtgttgcttttagtaagaatatcttcacttttttcttaaaagtgaagtaagactatcttcacttttcttaaacccattctattaaaaaagaataaaaaaataaaaaataaaacaaaaaactttactacattctcatctgggtcatgatcagtgctgaaatactaaccacaatagattctaactttgaaattttgacaatagttatcatactccgagtgtttactatgtacccaaataccaatactaaatattcactactcagtactttattataaccacatcacaatactttgaaacacagaatcattaaataccatcattttccgatgaaaaaactcaggtgtaggaaggttaaggaatttgctcaaagttatacagctagtaagttgcagagacatgacttgaacccaaatctcttcgactctaaattcagagctgttgaacttggcagcagtataaagtcactcctccactcaagaaacaccaatgattttatatcttatgccacaataaaaagtaaaaagactcaaaaataaaacaaaacttaagatttatagttatctggccatttcttgttagtttaatcttaattttcaccagtcatccacatgggtccccatgctaccaccccatgttccttaaagttcttacaagggcccagttcacttttgtcccttccctcacattgttttcctcacagtagtcttctgaaacgcatttcctgtctctccttcccataatcccactgttaccccatgtgcatattaaactcccaggccatgtctctataaccatacacagtttaatacagttgcaatccaagttagtgttcatcatttagctgctatagatagtagttggtgtcatgtagcttacatttgtatttcacctaaagtaaaccattatctattaaggtcagggactacaaatttataatttgattttttacctcaaaacacactatgaaactcatagagagctctaaataaattcctgttgtttaaatgaataaataagagttcattacaaatataacaaagtattttcacatgaatttcctagacacttcatattggtgtgagccacttcaaaacagtacaaaagggattaaatacaaatatatctttttaatacttattaaaatgttagacaattcagctttagtaggagtttaattataaaatgaaaccaagcaaagcctaaatacctaattcaaaagatttctgttctatagtgaaagacagatcaataatgataaattggatttttagcctttgggaataaatggggaaccaaaaagaaaagcaaaccttagtaaagtaattctggtctaccactagtgagtggacaaaattattttacaatcagtattacattctattggaatgaaaacaagatatattaaaaccttaacatgataaatagatatttgatattatttgtccaataataatccttaacagatataagcttttttagaacatctatgtaaccaaatgtttttgaaagaggaccaatccatttgctaaagccataaagtcatttagaactactgataataaacagtgacaaacagtgaaggcgatggtttcggaatacttcactttccttttcattcctttttccctcgcctttacaccagcaaagaaaaagtcatcataaagccaatgaagctaaagctctagggctacctgcttacacaggcttcgtcaaagtctatctatttataaatagcaagtaagatttttaaaattccttttcttgaagagtgccctccaaactgtttaagcttcaggtcccacaaaccttaattagtcgcatccttgacctgaagcatgcatgcccttggaatccaagaaacttaaaattccatttggcaaaatttgctgttgttgttgtggctttcttaggctgttggtttcctaattcgttcattcattcattcttcattcatccactcatttatccaaggaacagagactcatcttttgcaggcagagatcatcgttcttacggctttagagtgactacaacttcctgtctcttgttctatggcttctgccactaacaggtaaaggcatcacgctttcctctggatagcttttctgtactttatgccttccgtttttttctcatcttttgttgttctctctattgacctgtgcatttttgctacaagtagttacttcatcctatatctggtttatggttcccaagattggttttgttatatctgtagttattccttgttgggcaaaactttcagagtagactaccagcagattatttgcaggccataataggctgctcactataacatgccctgccctggtcaaacaaatggaagaaaccaacaatcgatgccttccatgaatccacttttactttctttctttttcttcctcacagcattattatttcaccttcataaccagaaaaatataattctatccagcattataattagtcaaatatttcatgttttatttattttttctctatccccacagggcttagtgttaattgaaataatatcattataattaattaaaatacaaatacagctaccatcatcttactatgtgtttggaacacaactattgttttcatgtgtcacttcccctaattctctccaaaccccttgaggtagttgttactccattaaccatttcacaaacggggaaagtgagactcagagagcttaggcaggttgctcagttaataagcatggttgctaggatttaatctaggaggtctaattctagagcagcaactttcacttgtgaacactggaatcacctgaggagtcttaaaaatccaggtcccatccccagagtttctgatggatagaagatgtagcctggccggggttgccgggggggggggggggggggcgctgtttttcatcttcctcggtgattctcctatgtcccaggtctacagaccaagttatttaccattaggtaataaagagtgaatggacaattgaatgcattaatgcatgacctccccattctctattttttaatagataggttctgagagttccatttaaataaaaacatcaataacatctaattggcctctcagaaaataatgaaacccattttgtcaaaattgatttaccctgaccaaacctgttgccaaagagttaatgctctttcccggagagaggcagtgaacagattccgtaaatgaccagcttagtctaactccctttttcacgtggacaggggccgtgttggggaagctgcagagcgcatcaaactgaagctgtttgaatgggcccctaggtccatttctttgttttatgtcctccaattccctcagcctattatccttaatgtgtcatccctacttgttttgcctctactggggagtgggagcctcagcgctacaggcaattagcactcagagtaggcaatgggagcttcattttctaccctgcagccaaattttttgttagtcacagtcaaaccaaagatacagaataaagaacctagacaaaactataaatacttaccaagcaccaatttgttatgtgttagtcactgaactgacattataaagtgactaagaaattcaaggagttaataacctggggtgggtgagaggaggataggcatgtggaacaagatgagttgtgaatatttaacttgtgtgtgtgtgtttgtgtgtctatgcgtgattcagtctgatcatgctgaggtttgtgaaccaccaccttatcaactagttctacctactccttatagaactgaggggctaactaaacaggcatccagtcagagcatctgtgacaattagagtccaatccacaaaccctgcagcaaacggtccaggaagccaaactgcaaactctgcagcaatcagcctagagcaggtaggtcttggccaataacaaccagcgtccctgacttttgccttgcttccaactcaggatcaaccaaagaaaattaattatgctccccaaagcagtcatagaagatgctccacttctaggtaacctgccctcagcttccctgtgccaacaacctccaatcagggcactcctgaagccttcccattttgcattataaaactttcccattcccgtgtctgcctttgagtctttgccaaaatgcaagttgcaagagacagtggctgactcccttgctgtagcaagttctgaataaataacctctgtttcttctcatttaaattgcctttgtttatttttacagtgcaagtgggtggtggggggtggtggtgcggatgctgttttgaaattttaagctcaccctctccaagcaggtgaaccttctcatatgtgtttccctgaaatctccttgcctcccccttaagatgtgtgtaggaagggggaaggcagaatgacagaaagagggaatggcacctgcatcaaatccagacagatcaacccaaggagacagaggcttgacttcttgccagtgttacagtggcatttgaataagaacctaagaccttagcctcaacctctaaagaggaatgaaatcgtgaattcagtcaccattatgtttgaaatgacagaaaaatcacgccatccattgagtttccttagatatgatgaggtttttgaaacatcatatgcaatgaacattcaagcaggaatcaagttcagttagggagaaatacaattatattttgtcatggttgaatactcagtggtgctaatttgggttgcctactttggaagtttagagaggacgatatgcactgagaaagggcggagctcagggcccaaatggtggaagaggtagcattttgagctgaccaggaaagatgagaattttgagaagtggaactttagcttcctccaggctccagagacattggtgcaaatgtcttattgaaattaagcacataagtttaatgtaatacagaagtcagtgcagtggctatacccctgtccctttgctggttgtcagctcagtgggtgggtggatgctgtattcactcaaatctagaaagttgtgagtacactgatgtctgtgggttgggtcacaccaacccacagacatcagtgtactcacaactttctacatttgttgctgaggttctttttaatttctacaattattcaacatgtgtctgaatgctaaaaataactagcgtaaccaaacatagagagaaacattttcttgttaaggctgagtttttaaacaaacaaaaataatgcctttccccactgcctaatgtacatttttaaatcatagaaattgggttctttgttaaattcactgtccctctttctctccaacattgatattagtaagacagttttttttttctcccttctagaagaatgtggcagaatgagcacaaagtaattagcaggtttagttagaagttagaaactgagaggcaaatgaaattaaagttggggtaaattaattagtaaaaggtgctagagttgtgtgtgctccttaactaagtgttgtctttcaatgtgtcagcactgacaacactttgtgaggtttagaaacacagaagaggaaaggctgacaaccagggagccagaacgggaaggtgttgagcagggtgtgagactcctgggaagggaagaataggaaccatccctgggattgttctagccttcccaatcctttcctctgaggttcagcagtgcaagggagaccatcaggtcaacgtgggggagggtacttggcccatgtttctagacatcgggaaatctgtgctgaggagccttggaggccagtgtccattcataagagcctaaagtccttacgaagaaacaaaaacaaaaacaaacaaaagctgggcctgtatattagttttctagggctgccatagcaaatatcacagactagggggcttaaacaacagagaaatctgttttctcagttctggaagctgtaagtccaagattaaggtgccagtagagtgttttcttctgaggtctgtcttctccccgtgtcttcacatggtcttccctccctgtttttctgtgtctgtattagtctgttctcacactgctataaagaaatactccagactgggtaatttataaaggaaagaggtttatttgactcacagttctgcatggctggggaagcttcaggcaacttataatcatggtggaaggtgaaggagaaacaaatgcacatcttacgtggtgacaggtgagagtgagtgtttgtcagctcaggaaaatctaccatttataaaaccatcagctctcatgagagttcactcactatcacaaaaacagaatgagggaaaccgccctcacaatccaatcgcttcccaccagttctctccctaaatacctggggattaaaattcaagatgagatttgggtggggacacaaagcctaaccatatcagtcctaatctcttcttcctgtgaaaacaccggtcttactaaattaaggcccacctcaatgacttcaattaatcttacatacaagtttgaagagtccatctccaaatacagtcacattttgaggcactaggggttagaatttcaacatgtaaattctggggaggcacaattcagcccataacagcttgctgaagaattctgtagaaaaggaagctgagtgtgtgacagtttgccccactgtgtgctttaaaatgaactagcttctcgaagaatacataagccatcttattctggaatggcataagtgctttcttgtccccaattctccagcaaaaccggctgggcaaggcaggagacattacaactaccaaagctattccaatccatacacaaccccaggtgactcctacatgaaatcagccggccctttgccccactgctgtccggcccccttatgcagaaaaaggagtgcaaaggcaaagggagaaggcatataggagcttttacacttagaaattgcagagtagttatttttcatatgtattaaatcctggttttcttggttgatgggccattatgattagaaattttacttgatggtatgaaagcatcttgctgttttctttgtttaattatttgatggtgagtaatcacatattcaagcctaagtcactcgttacatattttaataagaatcttttgtcttagaaagtaaaagtgctgactgcatgccttctcatttggaaggcagcatcttgtaatgaagtcagcaaagacagagaacatgttttattaaaatactacttctaattccatctgtgtgaccttgagcaagttacttaacctgtcggaactacatatttctcattggtaaaatacaatcatgtaaaggagaagtaagtgagatattgcatacaaaacaacaagcatattgcccaaaacataaccttttgcttatctaggttaattatgcaggtagattcccatgtttccagtacgatgtcatgaaaataaaaggaccccatgcaaggatcccaaaagcctgattgtaagtccaatttgatattttgttcaatcacttggcctctgtcagcttcagaattttgaatgttaaattggaggcaatggccatcttttgaacttgacacaatttatcaagaggatgaagtatgtaaaagtatcaaaaatgagtcactggcaggctctgataatgagttaggagcatctccttcatcataaagagttcatttttggggacaaagtattaactctttgcaaattactggaatgattaggtaaaatttactaaaaatttctcttgtaggaatcatttctcagccaaacaatgtagcctaaagaaagtggggctaattttgcagatcaagttttttttttttttaagtgcgtacacattttgaaaatcaatattttcccccaggtactcagggttaaattgctcttgtaggaatcatttctcaaccaaaacaatgtagcctaaagaaagtggggctaatttttgcagatcaagcttttctttttaagtgcgtatacgttttgaaaatcagtattttcccccagttattcagggttaaattgttcttgtaggaatcatttctcaaccaaaacaatgtagcctaaagaaagtggggttaatttttgcagatcaagtttttttttttttttttttaagtgcgtatacattttgaaaatcaatattttcccccagttattcagggttatctgataattcttagcccagtggaaatggaaatggtacctgcactccacatttcctaagttctgaatttgtttgatatatgttgttccacagtcattgtttccaggtcctacccctgcatccaacaataaacctggtattcaaacaaagcagatgtcgagaatgaggatgaggaagtgaggtgagaagggcacacatgtgaagaggacatagggcataccctctagtactttcaactttaagttgattctaggacattaggatgacaactgagtctggtaccttgctccagttctagtttctacctgaaggactctagagatggggaagtttctgtcaaagagtttcttctctggacattttttcccctttaagctactggttaaaaattactgttgactggctgggcacggtggctcatgcctgtaatcccagcactttgggaggccaaggcgggcagatcacaaggtcaggagatcaagaccatcctggctaacatggtgaaaccccatctctaccaaaaaaaaatacaaaaaattaaccggacttggtggcgggcgcctgtagtcccagctacttgggaggctgaggcaggagaatggcgtgaacctggaaggcggagtttgcagtgagccaagatcgtgccactgcactccagcctgaacgacagagcaagttaaaaaaaaaaaattactgttgactttgacttttgggtaaaatatgtattcttttatttatctcatttatatttattgaatgcctgtaatgtgacagggactgttctaggaacctgggaaacatttctgagcaaaaaacagaaacatccctgtcctcacagagcttgtgatttcaaaattatctttttctgagttaaaagtcaaccatttgtttttaaagacatggtggagcatggcaattttcaaactttttgatttcagagcctctttacgctcttaaaaactgttaaagactgtaaagaacttttgttgataccagttatatctatcactatttactatattaaatgttaaaacagaaatttaaaacaataaacaattttaatttattaaaataatgatataaaaccattacatgccaaaaataactgctacagaataaatatttgtatgcccctaaaattcacacgttgaagccctaacccccaatgtgatgatacttggaggttattgggttgagataaggtcatgtgggtggggccctcgcaatgggattattgtccttaaaggaagaggaagagataccagagtactctctctccactttcatgtaccaaagaaaggccgtgtgaatgtatagcaagcatgtggctgtctccgagccaagaagatggccaacaccagaacataaccacgctggcaccctgtgctcagacttccagcttccagaactgtgagaaaataaatgtccgttgcttaggtcacccagtctgtagtattttgttacagtagcccaagctaagacaataacatattttgtaaaaaaacaaaaaaacaacaaaaaaaaaacaacaaaaaaaacctatattttctttaaaaatcatgagaaggacactgttttacatttttaaaaatatatatattttttgttctggtttaacagaatagttgtattttcatggctgctcctttattcaacttgtggtatcaacgtcatacagtgtttggaaagtcccactatacatttatgagagaatgagaaagaaaaaggcaaatcatgtattaatattattatgaaaatagttttgtcttcatggatcccctgatggtgtctcagagatccctgggggtccctggactacgttttgagaactgatggtatagtgggaaaagtgcctctctgctaaactgagttttgatctgtgatcttgagaaattttttcatctctctcaacctctgcttcttccatctgaaaatgagtcgtttgtcttacaaaatgggcagaatctttcccatctgtgaccttccttgctctgtctgccctctttccttcttgagttggccatttagtattttaatggaatggacttagttttctttttcttcttcttttgctctccacattatccccatattcctggatctggcactaatcagggctagcataaaagaaggggggtctttgtgatatttgaagcttaaaaaggtacagactcctagcaaaaaagtccagggctagtctatgcagcctcaccttgacagtgcagctgacatagtattgacaacagatacctgaccccagaatggacaggtaagggcagctttctttttatttatttttcctctccctcaagagcatgatctcatctacatgatctcaactccattcagctacatcctgaaaaactgtgatgactgacaaaaggaaccgaagtgggactttgatatgggcaaataagaagcaaagtagtttagaaatatccaagacaaatagaattccccggtgaagtcagccccacttggagacagtggcttcataagtcctgaatgatgcctctgcccctaccttttgctccagagaagcctccccagtctgaactctttgctattgagaagccagcgtgactagatgaataagcagtggttctcggacttgaatgtgcatcagaatcagcaggagggctttttttattttattttgtcttattttattttattttattttattttattttattttattttattgtgagacagagtcttgccctgtcacctaggctggagtgcaatggtgccatctcagctcacagcaacctccgcctcagggttcaaatgattctcctgcctcagcctcctgagtagcagggattagaggtgcccgccaccatgcccagttaatttttgtatttttagtagagacggggtttcaccatgttggccaggctggtcttgaactcctgacctcgtgatctgcccacctcggccttccaaagtgttgggattccaggtgtgagccaacgcgcctggcccatcagggctttattaacacagatttcagggcccatttccacagcttctaattcatcaggtctggggtagagttagagcaattgcatttccaacaagttctcaggtgaccgcacgttgggaaccagtgcaacacagtaaattatagatgatttgagctaaaggatggcaatgagacttttggactctgaatgtctctgtaatctgtttacaaaacaaccatactaccaggcctccaacataatagtttgttccattctaacctcttatgattaagggtgaagtaaaaagggtcacatcactcactatatttttagagtagttattctaagaggagattctataaggagcacactataacctttttataaagcttattttctattttatgttctcctgcttggggtgggagggacttctagagggatggcaggggttactatatggttaaagccttaatttgaacaatttctttttagtcgttacagtgcagatgtaaagtattagcagtgaacatggggcttgagttcatgattgagacagggtataaataccctgcaattatcttaggcagactgagcctgtaatctttccagtctgggtttagcttcatttttccatgaccttttaccaagtataaacacaacgtcaaagattctaatggttgaaataaatgcagtctattatgttatacaaattaagatcagtgtttggaagtccagggctgaaatcagaagattttgtggagaccattacggccatctggtaagttctccctggccttatagggccaagagatgagaagataataaatcagttaagcacttggcattgtgtttgtttcacatacagtatctcatccaatcctggtgatttcttttggtagtgagagcgactacaaatagaatccctattcaacatacaggaaaagagaggctctgagaaatcaaactatttgtttcaaggcagcccaactcaaacagaactcagatttgagccattgtgtatctgactctaactcccacagctctcaggaaacacaaaattcaactttttgacaatgaatatttatcaatatcaactttgttgagagaagagaaatagcaaaaaaaaaaaaaaagaaaagaaaaaaggtttttgtctcttggtatttccaatttagtgaagagaaataagagtgtttctggaagggatcaagttcaccttctcattttactcatgagaaaaccaaggtccagagaaatcaaatggtttctttgtagacaaaaagcaagtagcaagggtgtcttgatacctttaaatctacagagaaatgctgaacaattctttctaatgaaaaatttgcttatttaaagaattctttttgctttcttgccaaagcaaaccttccaggtagaaagaagactggtatctaggcttttacatgggctctctgtcaaggtcaggcatgaatagcaagtcctaaattctcacctgaccttgaaggtcctgaaatgctctttctgttcctgcaactggccaagttgttttcacctctggacctttgcatttgctattctctctacctgggatattcttcatttggattttcatgaggccaagtcttactcatcactcaggtctcaactcaagaagatcccctctaagaggtcttccctcttggctgtcctaagagcccaggatgtcagttctcttacagggcaattgcttctgcatcccattaccagagggagtgtgttctctgggattaactggctttcctcattttactgtctcacttccccttctctcaccatacttactgagatcaactccctaatacatcacttgcctttaattccttcttttggggtttgcttttgtgacaacccaaacacagaaacgaaatcttattcaacctgtctctcatgactctgattattttttatagcacttattactactgtctgaaattattgtatttattaacttgtttatcatctgcacttccatcttacctgactctccgcactctccccaacctcctccaccccatcagacgcctaatagaatacaaacactgtagtggcatgactttgcctgtcctgttcactgtggtatcccaaaaacttagaacctagcccataataggtgcttaacatatgtttattgaagaaatgaaagaaacaaatgaaactctccaatgtgttaatataaaggaatcttggctagtaaatcgtgattttgaactactaaatcaaaggctttctctgtttgcttcagtcccatttagattccattgttctttccatttttggagggaatcaatccttaatcaatcactttttgctaagcatgctgtccctgcacaatcaaaagttaacaaagatatataaaaatcagtccaggctttggagccaaaaagttcattatctgcctcaatcaatatttataacaggtatactgaagacatgctaaagcagaagtctctgttcctttgctttccttccatcacatttgccttgcataatcatctatgtttattaaaagggttcctggtctgttcctgttaaacattgaccttcaagtgcttgacttaataagctggagaattacaataaatcagacagccttgttcaatcattgatattacaaagaattgcaaggagaaaccagaacagcttgaaaacacaataaagtacaacagctttcatagagagtaaaagggaaagtcaagggaagaaagtctgttctcagagatgctctcatggaattaagagagcagaatcccatggcattcaagactgttttccccctgattaaaacgttttgtcaaagcaaaaatcaaatgagtacttgcttatgaagcatgcgatgtttcagaacatgacacaggaatcataagtgttcaaataaataaaccccattcaggaaaaagagcatttgtcacagatttttccctatatgaagccaatataggagactataaggattgagggtaaggatgctattccctgaaatggtttgcctccataagagattataaggcaccaaaagtgcagatgtctctattctatttaccaactccttctcataaacccggtgcctagaaaagggcttgccacatagtaggtgatcaatgcatacctcatttagagaaagaatacagagctatttgtactttcttgggagcaaaagattctcatttgcaacatgtttaaactagcatagcccatctttggcttacgttattatcagtaaggagcactatgattatgtgctatttcttacatatcttattgcatccccagaaacagataatattccatttagataagtcttgtgttaagaactgaattctgtgtgataagtaaaagattagtatttggagccaggcgcttaccattctaagctttcttttcctgatatttaaaatggggctattaatgctaatcactttataggcttgacggacagattaaataaggttgttgatatggtttggctgtgacactacccatatctcaccttgaattgtaataattcccaggtgtcaagggcagggtcaggtggagataactgaatcacggcggcggttcccccatactgttctcgtggtagtgaataagtctcatgagatctcatggttttataaatgggagttcccttgcacaagctctcttgcctaccatcatgtaggatgtcactttgctcctcctttgccttccaccacgattgtgaggcctacctagccacgtagaactgtgagtcaattaaacctctttcctttataaatttcccagtctccggtatgtcttcattagcagtgtgaaaacagacagcatctatgtagcactcaggacaaagtagacactcaatacacattggttaacctcacatttcacgggtgagaaaactttggttcagaaggattggatgaccttctccaggatcaccccactgggaattagtgaagacagaatttcagaaaacaaaacttcagatctctctgaccacagaacccatgctcttcatccaagcatcattgtgtccacggcaaggagtgtaattcaggtgcaaactttgcatattttcatttcagtttacctggcttacatatagtagctgttggcatcaaaagtacttgcttttaaaatgatgaactggctgctgttgactttgggaatgggagtgaatttacgaaagttctcaaccttggggaatttttctcactttataatatagatagacagaaaacttgggtcattttaaatgcaagatatttaggagtggattcgctaagtttgctatttaaaatgtgtctgataaaagttgatgttcttgggataaatgtgtcataagttgagataatgtaaccagtgttgaagcagaaatgttaaaaaaaaaaacagtgtgaatgtaaatgatgttttgtatatcactgactcaaagacttcttacataccatcctcctacctatacttcatgctgtattagctgaactataaagtggcaagtggcaatgtgattttcattttctcccggcaaaacgttttgacctaggagggagccttgaatgaccttggccttccattccctgattttttactgttccttttttttttaatccttctatatcctccctcatatccctaagccatactgaatgtcttgcagttttgttagtcttgatgctacattagaatcacctcgcaaaattgtaaaagttgcagatacctaggcatcacttgcagagagtcttaatcagttgcttgaggtatcatttctaaagatttcctaaatgattctaatgcatagctgtgtttgagaatcaccgcaatttttctgcctctgaaccattacagaagttaaaatttctttctttctctttatcctctgtgtaattcctagccattcttcaaaatgcaattcagaaggcactagttccaagaaacgtcatcattgcataatgttggtctgcctttgtatttaaaaatttctctgtgcttcatgctaatccacaatagatttcactaaactaaattccttgaacatgaagacaagccatggaaattgtttgtttgtattcatagtgcctagaattgtccatgtaggagctatttaaaaatatgttaaaaatgaatgagtggttgagaaaggaattcttaaaaagaggttaataactctgggtacttgtcctggctgtgctgtttacaaatttgccctataactctgatgctatgttgactgcaattagatttaaaatactatagtatataaagttaaacatatgcatatattatgactcagcaatttcccacttagacatccaaagaaatgtatagataatcattgagttataatggggttacagtccaatatatccatcataattcaaaaacactgtaaattaaaaattcacttaatatccctctaaaccctttttaaacttacaaaatcataagtcaagccattgtaagtccagatgctccttgacttatgctgggattataacccccaaaaggccataatctagttgaaaaatcctaaattgaaccattttaggtcagggaacgtatttctgtatatatatgctccccgaaggtatgtagtagattgttcatagtggcacatttttaataaccaaaaagcaaaagcaatcatcaatgtccatcagcagcaaaacggataaaatatttgtggcatagacacacataggataccatgtagcaacaagaatcctataaacgcatgcaatgatgtagatgaataatagataactttgaacatatggagccaatcgcaaaaaagtacactattgtatgttatacatttacatatagaactaaaaccaaaaaagcaatctcttctttagaagtcagggcagtcgggtggatcacgaggtcaggaaatcgagaccatcctggctaacacggtgaaaccccgtctctactaaaaatacaaaaaaattagctgggcatgctggcgggcacctgcagtcccagctactcaggagattgaggcaggagaacggagtgaacccgggaggcggagcttgcagtgagccgagattgcaccactgcactccagcctgggcgacagaaggagactcagtctcaaaacaaaaacaaaaacaaaaacaaaaataaaaaccggaagagggcaatgattggaaggaagcacaagggtggattctggggtgctggttgtgcttttgatctggtcattgattaccctgttgtgtccagtttattagaaatacatcaagcagtacactttggatatgtatacttttctgtatatacattgtacttccatgaaaagttaatactttggtataaacaatatgatagatttgtatttataaagtgactttgatctaaaccttagaaacacttggttaatatctgaaagaatttaccttccaggtatggcttctcaaatggggccattgtattggatggcagtgttaatcagtgttaattttttcagtcagagagaggtaccgtggtaatgaggagggcgtgtgatggagattgtgtgtgaaagatggagatttattgtgctgtcctgacagatgtttactaagttttaaaatatttcaaaataaataatttaaaatgtgaaaaaaagagaattttgttgcccttgtttcagaatcttccatgcaaaatgtttatcaagcctcgtaaaagcaccaacaacaggaatttcaccagccatataagaacagcctgtttctgtttaacttgttcttctatcacttactattaaaagttttgtccctttgacagaatcagatttgccacttgtatttgtaatacaccaccctataaatcattaaaggcctccaatgttcacccaaatcctcatacttgtggaatgaatatgccggattaggagaagccatttatcctcttggatactggatccagattattctcatctgtagagcattgggttgtatttgatgacattctcagtttttaactttgatctagattattattaaaagtgcctcatttctctctcagaggtgtcttggttttgaaaataattatatggttttcctgcttccaaggaatcttccagatttagctttctagacatctatggttttaaagatgtgaactagattcagcagaccactgaagtgcggggtaggcatctccctgtgtgtttgtccttgtgtagcagatgcagatttataacatgttagaataagaaatttttgcggccaggcacggtggctcacgcctgtaatcctagcactttgggacgctaaggcaggcagattacctgagctcaggagttcgagaccagcctgggcaacatggtgaaatgtcgtctctactaaacgacaaaaaaaaaaaaaaaaaaaaaattagccaggtgcctgtaatcccagctacttgggacgctgaggcaggagaattgcttgaacccaggaggcagaagttgcagtcagctgagatggtgccactgcaccccagcctgggcaacagagtgaggctccatctcagaaaaaaaaaaaaaatgttttgcaaatgtcaaaaattcaaaaataatcccttttagggaagggaattcattaattgcctcattgctaatgattattacacatgctaagatttcccttcttgagtgatgctgaaagtaggacagaaggatcacgtcattaagacattcctgttttcaatgtctctgggtttgtcctatttacaatcaaaagttgcctacttcctcacatacacaatgttaatgctttattttcaaaacctcctgggtttaacatgtgtaattattaatttattcaacaaatgatggagagagagagtacattatctgctatgtgccaagaacttaaaagggtcagggcagattattgaggcaaccggaaaatgaggatgattccttcagtccttctgcatcccatatttccatggagtcctgtgggtctttatggcaactcttgttttcttaaactcttattccctagtccacatcttgtgctaccttttcttgtcttctattctgcccaggctccaaggttaggcaattcaactatcatctccctgaattaatcaaccgtcttcatcttccatcatcctaatctatactgctcacttagtaaatttagtaaatgccacttagtaaatgccattcctatttgctaaatactgacagttaagacaattttaaaaatattactacaatttcttctgattctgccataatttcttgttatgtgatctcagtgaaactcatgagattttttctcatttcttttattaagttgtattttgttttctaatttttactctcaagccaccaactttcaaagaaggaaacatacacactagaaagcccagacgttttgcttcatggagtagactgaggccattagtttccttttctaactcaaagtttctctgtgtcatcattcacatctttcgacttcccttctgccctggaggaaagaatgtctttcttctttccccagttgcttggacactagtttccttctgtacaattctttcttatctaaccccccaaacccataaaatctaacttgagttctcaaaatgagactaaatttgttctgaggtctccccagaccacccacaggtgacctttgaacaacatgggtttgaatgacccaggtccaattatttgtggattttttccacctctgccacccctgagatagtaagaccaacccctcctcttcctccttcttagtctactcaatatgaagatgacgaagatgaagacttatatgatgatccacttccatttaaaaaatagtaaacatattttctccttcttttaatctttttaataacatttcctttctcttgtttacttagttgtaagaataccacatacaatacacatagcatacaaaatacatgttgatttactatgttattggtaaagcttctggccaaaagtatgtcattactagttacgttttggaggaatcaaacgttatacatgaattttcaactgcaaacgggggtcagcatccctaacctctgtaagtgtcaactgtatttccaaagccaataactcttctaagtttgcttttacatcactaaggggatttgaaaattggccatcctgttcttgaaattctttcttctcttggcttcttctcatagatttttccttctctgctcttccccaagattcctgttccatttcctctactcttgttttctgaaaatatacatcccccaagcttgtgtcctctgcccactattctatcaatataatcccattcactgttctcatgaatctttaactgtcttttaccttagaaagccatattgtgagtcaacacagagctccatgatgcatagccttcggccataaacacagctaggaaatgagggcagaaactaccatgatggagtggtacttcttgacctaggcacctggcccatgctgatggcaccaggagacaaggctgcaaggaaaggtcaactttacaaatggcatcagtagaactagaacatgacaatctagctacaaaattctcacatacggattcaggtaaactccgagatcttttacaatgaaccattcaaagactgggatcacttaagacagtctgcagaggtctcacaaaatggacattttagaaaagatggtcaggttcaccagactgcctcttataaagtatatcattgctgctctctgctggtcaaaagcattattctcttcaattaagatgagcagaggtgtagaatgggtcaaagagggaaagcagtgctttcaaaatgatatggactggtgctaggtaagacttattaaatgacttcatagactgcaatatacattcttatgcagaaacactgattttagtgagggtctattggacccctaaagtaaagatgtgcaaagcatccccatttttgtagaccttttactcatagaaaatatgggctctatcagatatttcttcaaccactaaactagtcaccactttttagtgtagaacttactgtaaggcatcatgtttgtatttttggcaggaaaattggcaagtcctactgaggattattaacttgatatactgcaaaatcctaaaatgttatcttaatcctaaaataaagattaaatctacatatacgtacaatctattctactgaaaacttatttttaagagtgtatgggtagtagtttttgattattcagaatatttgcatacaaagtgtccttcatgagcagcacaaaggggcaaatcttgggctcgaaagcctaacacacaggtttacccaggctctgccacttactggctttatttccttgggtcagctcttgaatatccttgagctccacgtccctattttgaaatgcgggaaatcataatacccacctcctattgttattacaaatattaattgaaatattccctatgaaatgcttaacagtgctccctgcaagttaattggcagtcagtcataactgttactattcatgtaaacagcttaagtagtagtatttattacatcttccaaaacaaaaatattttaccacgggttttaaatatactatgtagatatctggagaaagttgtctttagagctgttcttagctctgacactggctgtgtaatttaaagtaatgtcttaaattttctgagccttgaaatgtttccggatgcttgccgtgccctaaggtcctaacatgtctctatgttttaattttatttaccactgttcagtggcctatggtacaaagggttttgttttctgacctactgttccccacctaatgacttgcctgaagaacaaattaccactggaggaagcgagtaatctttctggagaattagcaaaggataatttttagaaggaacaatggaagcagaaaagtacacacgcacaatcttgcctttctcttttcggatattaccacactaaaatatgatctgactcttctgtgtttattagttcagcaaataggcattgggttttcactgggtttgtaaactagaagttacagtgtgctgaatcttgagaaaactgattgctagaggtagaacaacaagaatgttccagatgtttcctgtcctttcctccattcctccattaggtacctctcaaagcctaagttgatgataattctcttgggatgcaggtttagacatgtctatattaagagacatggcagggagtcctcctccagtccaagcaaactcatcaagttccatactactgctggagggttccagcaatataaattctacagacaaagcagtgtcagtcagaccccagagttttgatacgacttagatataagggttgagtcaggacaaactattaatttctgtcttctgtagtcactgtcccttttccttgagaatcttcctcatttatttgtgacttcctcctttctccaacaagacctctcgtacctttttatgatgctatacaagctcagctgcctccatgctctgcccaggcctgccttccttaactgcacactgtgggcccttctcataaccaaactctgggttccattcctttgatcaaccctactgaattcatgaacacatcaggctaatatttcccttttctgtcctgtcgtcttggcaaaatatttgaacaagagggattagggttgaacatggtaaaagatcaattctcatggttagatttcaaggccagaaagaccctgaaaacctttcagaattgtggtacccgacgacaccaccagtgcactggaagagctccctctatcacacagagcaaatgacagaagaagcaaccctttcaatcaaaagacagcagcagtgaatagcatttccacagatgaagaagatgtggaacagaacttaaatcccttccaatggtttcctcgatgctcaagcttttcttatcagggaaggcagggtaaattcttgttctcccccatactccatatttttcttttttcatttctttgtaatacaatatttgatacatttgaagatgccatatctttagttaaaaaaagaggctttgtttgattctaatatttatcaaattagtaaactcttttagcatcttatcatctagtcaaaatgcctttagagtgatgtcttagatctgagtctgtgttaaagtaatgttttaactttttggagcctctgttcatctgctcaacaggtataacaattcctgtttcaggacttactacaataaaaacatggtaaaatacagttatgatgagattactagcattttaatgaaaaaagcagtggtaaacttagaaataggaaatttttccatagtaataaaaactctagatgttattatgaacacgtttagaaataatagttaataaaacatgtatttttctaaaatgaaggctttttcccttacacaggcttttttgtttttttttttttgatggagtcttgctctattacccaggctagactgcaatggtatgacctcagctcactgcaacctctgcctcctaggttcaagtgattctccttcctcagcctcccgagtagctgggactacaggcacatgccatcacactcggctaatttttgtatttttagtagagacagggtttcaccatgttggccaggttagtctcgaactcgtgacctcaagtgatctgcccgactcggcctcccaaagtgcatatgctgagtcattgccatctacatgtcttcgctttgctggtgttgtttctgccacctggaattcttttttctatttccaattccttctcaactctgtgccctaaggatcccactcaaatagtgtaaatattattaattcctcaaaactcagttctgtcagattccccatcttatttttcttattgtacttataccttgcttgtcaaactttatattcttatatattttcaaacacaaatatgctttttcatgctgtggtctttctgtctacagagcatgccatcattcttgttccttctacaaatcacttactaatcctaaaagccaaattctgaagactttctcaataagttcttgcacaaaggtaaggcacttctttctttttcttcttcttttttttggttgttctctcaccattgttttacatccctgtggttggcagaattatggcctcatgatgtccaagaactagtccccaagaactatgaagatgttaacttacatactaaaagggactttgcgtatgtgattaccttaaggatcttgaaatggggagattatactagataatcctggtaggcagaatgtattcctaaaggttgtaaactgaaagagagaggtgggaggctgagtgtcagggcaatgcagtatgagaagactcggccgccatggctggctttgaagatggaaaggagtcatgaggcaggagtgcgggcagcctggagaggatgggaaaggcaagacggattctcccctagagtctccagaaagaaacacgggcctgccaagaacttcattttaccctagtgaaagtcattcagacttctgacctccaaaacgataaggtaataaatgtgtgttgtttccaaccattaagtctatggtaattgattccagtagccataggaagccaatacaatcactccactctaacactaggtatttttttaacttgggtttgcatgttgctttatgttagatttctttaaaaagaatcccacatcacactaagactcttatttatttatgagttttctctggagcaaaaatcaggaaagtgagacctgcagcctgagctgccataggtgcattactcgtttcaattatttgctttgtcctcggaagacaagaaaacgaaaaagagagacagataagacaaaaatagaaacgtaaacaaaagtaagcacctctttcagttttattatatcagtcagaagtacttcaggtaaaatgggaagaatgccaacatgtttttgagcatgtactaggtaaaatggtcattagagaaactgtgaatttggatacatggcccagatgccccttcaatgatggactttgcccagtttgctcagagtactgtcagcagaacaccccctgtggccagctcctcagggatggcttcagctgtagacgattatcttgctgtgatcacacccttcccagcccacatccaaagagacatgactttccatctcgactcaactcaggacaaccctaaaggaacgttctagccttagcactgcccctggaattggctgaggctttctttgaaagtgaaacacagctcaacttcttctgctcgggcttactgtctttctctccgtccgtccatagatgtgaatctcaggggcatcccataataaatatcctacacactaaatacctcctgaggggctgtttccgagggactctaacctatgacactatttttagaagtgtagaagaaaacacaagtgtagaaaggttaatttactctccctcagccacgtttaatgatcagtctttttaaccccagagtccacattctttctaacatactgagcttctcacactgggctatgtatcaagtcaaagttacaggatagatgtccctggagagtcaattttacccaattaccagaaatttaacacactctctcagattcaaaagttcatagtagagtgcgaaattcaatgagcttttaagaaaaagcatgatctttcaaaaaaatagtcttttatttattacaggcagctacagtatagattgccgtcaggctgcttggctttgaatccatgttttgctggttactacctgtgtggccttatgcaatttgctttctcttttgggcctcagcctctccacctaaaaatcaggttataaaagtacacattccatgagaatattgagaagaacaaaattatatcattcatgtaaacttcttagaacaacatttggtacatcttaagtgctcagtaagtgcttacaatcttatcaaagcccatcaaagcccattccctttcctctgtgtttagagtacttaattaactaattaactaatgcatctaaaaggattgcacaatgttaacataacgcacctcctctgtgcctcgattttaatttaaaactttatgctaataattttctgtctcctccaacgcaccccgctattctaaaaaccagcttgaatttaataataataatacataaaccctcaatattctcttatctcctaatgaatcaagtccaaacactgcaggctgctttccaatgccctttatgatctgaccctcatccagttttccagtcttttttctgaatttgccctgacaaagtggactactctagtccctgccccctcctttctttctgcaaaagtgcatttgctcaggttggttgccaaggttggaaagtccctgtccatctgctattgatcacctttaaggtcctctcagtctcagtttcttcatgaagccctccctgtcccctgcagcctgcctctgtctccacctccgctagcatgcattatctgggacagtcacttattgcagttgatccttttggtcaagtataacttgtacacacaggcataacttggagatgctgtgagtttgtttctagaccctggcaataaagcaaatatagcaacagaacaagtcagacaaactttttgatttccactgcataaaatgttatgttcatagtatactgtagtttattgtgtgtaatagcattatctctaaggaagagatgcacataccttagttcaaaaacactttaatactaaaaaatggtgacacagagacatgaagtgagtacatactgttggaaaaatggcactgatagactcgttcaatgcagggttgccacaaatcttcaattggtaaaatacataatatctgcaaagcacaataaaatgaggtatgtctggacaaacagactgtgagtgccctaagaacagggagtctctgttttctgtcttttcataacaagtactaagataaaaaaaaacttatagacattcaataattatttcttttgaatgttagtatttacataatcatcattttttgatattgtttgttctagttgagaaaaagtgtcagatataatttgaaaaaaatatgaagaaggaaaatttggtctcttctctgtagacaatgaaatccctgattttatgtagaaacatgtagagtctactgtgttggcttaatgtttgaatacacgcttaccatagaagaactcagataggaaaagtttaggaaaagtatgacccatcttttattgaaatgtacactttaattctgtgaaaatatttcaatgtaaaagaaatgatgcaagtaaatctgcatccattcaacaataaaatctctttttagggcattacaaaaggtaatgaggtcaagcaaggtaacatgtgagtttgtatatagtttcaggataaggagacaacagaaaataacaacaaaaaaaaaaaaccctggctcaagtctgtaatcccagcactttgggaggccgaggtgtgtggatcacgaggtcagaagttcgagaccagcctggccaacatagtgaaaccctgtctctactaaaaatactaaaaatttgcgaggtgtggtggtgtgcgcctgtaatcccagctactcgggaggctgaggcaggagaatcgtgtgaacccgggaggctgaggttgcagtgagctgagatcgtgccactgcactccagcctgggcgacagtgcgagacaccgtctcaaaaaaaaaaaaaaaaaaacccaaaaaacaaacaaaaacaaaagttaaacaaaatctaggctgccctgggctgaggatcttagaaactactttgatcagaagaaggacaaaaggagcttctgtattatttgttcggtgaatagtttgatctgaaatgaaaaagagcttaggccacgtaagattccagtgagaggtgatgaattggctagctttgggaataatcagtactgtgcattacaaataggaggggttagttacatctacacatcccagaacttttatactcctggaagatggcaggacaggcttatggctattctttgactttagctattctgttttgggggctctgtagtgaagattatctctaatcatcaacttgctgcttcagaaatgtgattttcaatcagggttcctagggtgctgagagctcctggatgtgtgagctgtacttaacggcaaagatctgaggtcagagttgctatcttcctatgtgtctcccgcccttgccttcctgccagcatctcttcaccttgtcgtgctttcagagcaggaactgacgcaaattgggtgttggactcccaagaaacgtgtcacagctatttagaaagtgataataatcctaatgccctgtaatgatttgaggattaaggaataaaactgcaaatatgatgcatggcatataaatgttgaaagtaggtgcttaaatggagacaaaatctgtgaaggagaccaactcatttggcattttcatattcttactatgtttagttcatatctatataacatagagaagtgtggatcctgcaaactaagacatggaggggaatttctttatacctgcaagaaaaaaaaattataaaagacattgaaactgaccaaaaagattactaggtgttgtgcagaatcctcaagatagctcccccaacattcaggtttcctagttatttgatcaagcattaattcaggtactccctaggaagacattttgcagacgtgaagtcctaagtcagttgaccctaaaatacagagattatctacataaacttaatctaataaaaccagcccttaaaagtggagaacagagaacttcgtccactggtggcagggggagaaacagaaagatccaaagcaagagaaggactcaaagctccattgctggtttgcagatagagaagattaagtgagaagtaataagggtggtctctaggagtggagagtgaccattgaccaatagtcagcaaggaaatggggaacctcagtcctacaaccacatggaactgaattctgccagtaacctgaatgagcttggaaggagattcttccccagagattccaggcagtagcccagcccagcaacaccttgattttggccttatgaaacccagtggtaaaggcagctgagataagctagacacttgatctacacttgatcataaatgggtattgttttaagccactaactttatggttatttgttacactgtaatagaaaactaatacacttggtgttttcaatggaccactaggctttgtttaaccacagccatcacagtttcttttttttttttgagatggagtctcactctgtcacccaggctggagtacagtggcatgatcttggctcactgcaacctccacctcccaggttcaagcaattctctacctcagcctcctgagtagctgggattacaggcacccaccaccatgcccagctagttttttttttttgtatttttagtagagatggggtttcaccatcttggccaggctggtcttgaactcctggcctggtgatccacccaccttggtctcccaaagtgctgcgattacaggcgtgagccaccgcgccaggcccagagttcttattctgtgaagtctctgtgcctttaactccccttgagtgagtgtacagctctgtaagttgtagataactgataacaatacaaatatttttgtctatagatacacacatgaattttatccttcagaaatacaacccccttctgccccatgcaataaaccagtattatatttgtcagttcacgttggcattactaatctgccaatatgtgagtggtactttaaatccttctttgaaccagttgtaacatccataccatgctaaagagttaaataaaatccttgatgtacttattttatatctgtataagagtcattattttacccttttataaaacatatcatttaatagagatacattcagagatttctaaaatttacagggcaaggactgtttattcatcccagagtttatgtcaaaaaaagagctaaatattgtacataagctcatctattcctcatgctaaacccctgaccctggtatgaagagtccctaattgaaataaagaaaccaaaactcaggcacatcacaaaacatactgtagagcacacagtgctggagtcttggagctgagaatttggcatactggaatataaagctactactacttccgttgttccatagagctttccaatgtaaaatggggctcatctcctttcaccctaacccagcatctcctccttatttcttcagtccattcttgatgtgaatattttcctcctcagtcaagtttgaaaacttagagccatttttgtcctttcatttccttttctttctatatccattggttatcaaatgccttaagttcagcatctaccatctcttgtagcctcttcctctttctgtttctgctactatcatctgagtttcttctcacactaatagcagctcaaataggcaaacaggaccagatctgagttttgggagtttggcacttttacaattttagagggccatctttagggaaaaaaaaaaatagtaatatgaatacaaaatgaaacatttattcagaatgagaaaataagccacaagaaatcaacaatcttagaacttcttatttctttgttttgagatctctgatggcaatttaccagaaatttttacatacaggtgattcctgactgtaactcaaaacccttccccgctctaaactccctgcaactccacctactcacaggggccatgcaaagaagtaaccctaatactcaggcttccgtagctttagaaacttagagtctctactatcaattctttttccatttttagtaaaggaaataaattaagcaatggaaggtctaacaaattattcagagtttcatggaggtggggagaggttacgaacctgggacgttttaaacactcagattcctgaattataacccaatattctaaataaaaacctgaggacatctgtatttttacaaggctccacaggtgaaatggatgcaactgacctatgaattacaaatttgaaaaccactgctctagctcaactgcatgaaaagtgacctgatcctctgtctccaaaggttaaagctttcagagtgcaacagagtcctccaatatttcctgggcactgtggtctgtacaatgcaaaattcagaagctataaaaaatggaggtgaaaagggccctgattaaagactgaaacagaagcaactgcttttctctctgtgcagctaccatactggtcttgattcaagtaaagcaatgtgcctgatgagaatcactgaagcacagaaaatggtctggtactgagagatgagcaaatgaatcccaagtatcaggagtacacaggaccagaaaagaagtatttccaatacccacgcctgactaaagatttcactagcctcttagctcaaagggacaatagataaacatcaggtctacactgcaaatttgcctgcatattaattataatttatttcttctatctttgtccttgcattagactgtttaattccgtgtatgaattcattttgaagtgtagagtccatcgttctcagtaattagctttacaaagtctatcatcgaaaatattgttttagattctttgaatacagattctatgaaagagaaaaatccttaaaagtgggagactcggccgggcgcagtggctcacgcctgtaaccccatcactttgggaggctgaggcgggaggatcacgaggtcacgagatcgagaccatcttggctaacacagtgaaaccccgtctctactaaaaatacaaaaaattagccaggcgtggtggcgggcgcctatagtcccagctactcaggaggctgaggcaggagaatggggtgaacccgggaggcggagcttgcagtgagcagagatcacgccattgcactccagcctgggcgacagagcgagactcgtctcaaaaaaaagaaaaaaaaaagtggaagaccaataagaattattcagattctactggccagagcaggaagctcagctaccagcatttatctttagactcctaccacatatgattgccccaactgaaacacaggtcagagagtctgctgtacttctaaagtgatgagaacaaatcttcctgtcactttatgtcacagtcatacagttcccgaatagcaacccatagatagagcccttggcaaatttgttatcagcggtgtgtgtttacacacatcaagtgtctgggaaataaagaaaaaaaggaaaatattgacagtgtagaggatgttctttcttctggaaactcataagattttgaaacacagctgaatattttgaacatacctttatgttcaaaataaattaggaaatgattcaatactaagcataattgaagtcatagaaaagcattttttattcttttgctctattaagacacatttcattgtttctcatggttactgagtggtacatcgctgtatatacatatttatataagtatattagatgtaccttttgtgtgtgtatgtatatgtatatatatgtggggggcatatatttatatatatttatagcaacatatactgtatacttctacacactttgctctccgtcctgggaggtggaccagaagggttaaaaagtgcctgtgtcctctggcttccggttgggctcagcctagggagtgcctggcctgagctggagggaggtgaggtattcaagatccctccctgaggcttggctgcaactgggtagggtacactccttgaccaaaggctacagttccattccttggacctatctacccgatgcccccacccccaaacctgggttccaataacttccctcttcactccttcagttctcggggaggcccagtttgcactgctgttgccagccagagagaccgtagctttccttatggtttccctacaacctttgtaaatagttcctttattaaactcttttcaaattacccaatttgtgtgatccgtatcttcctgacttggaccctgatatttttactgaatattgactagtaagtgtattgctcatgaactgaactgcttcagagttgttgagctcctaacacataatttattatttttctttattatcaaagtttttaaaaatgtatttactcctaatttctttcaaaaatagatttatgacaggaattattttgatgttatattccaggccattaaaagcatcaagtactttggccaggcgcggtggctcacacctgttatcccatcactttgggaggccaaggtgggtggatctctttaggttaggagttcgagaccagcctgaccaacatggtgaaaccctgtctctactaaaaatacaaaaattagccgagcatggtggcagatgcctgtaatcccagctacttgggaggctgatgtgggagaattgcttgaacctgggaagcagatgttgcagtgagccaagatcacgccactacactccagcctggacaacaaaagtgaaactccgtctcaaaaaaaaaaaaaaaaaaaaagaaaaaaagttcaagtactttgggaataatagtaagaggaattaaaaaaatcaagtactatttttatgaattctgggcattttcccctccaaatcatagaccaaagactactcaatgaatactcagtgaatctcttcatgttatgaaaatcaggaaactgctgcctaatggcttaacctttgatgtaatgattttcgctcagtagcttaaatctatgacaatgttcatatttattgaattctactctttgcctttaggctaaggaactatatgctttatgacattgtatattataaagaacaatctataccaaaataacaaccttcagagaacaaaaaacagaggatgctggagtcagcaattgctaagatactggacagacagcaaggtgagtaatggagttaataatctggaatatggaatactgacactactaaaaccatatttgggtgactaaattaacgccacacttctcatccacctacataatgtttacgcatccaatgatgatagttacgtttatccaatgtcaaggcatgcttacaccgttctgacatataatacctttaccaaatgctaattattttattaatttaaaaaatatttaaatataagaagtgaaattccactgtcaagatgcattattcattgtttttcctgtatcagttcaaaaaatattattcttaaaaaagaactggaccaaattccaactgtgatactacagaagaaaaaaaaaaaagctgaagtaaacaacattaagaaaggccaagtaaagtgacaaatcacagcaaataacaatttatccctactgaaaaggacagcacaattcaatttgccaaatcattttatttatctctgagtggcaatatgaatgatcaatctgttttgatgaacactaaaactttgctgaatgaaaaactgtgctgcctttaacatgtcaaatttaggtacagtaaaagaaaatgtgaattaaattggctttgagtatacagcattaaaagataaattgctagcttagaaatatctttcccagtagctttatttgaaccaaaatattttgcttaggaggaattacataagtgtgcaatctatataataattatttcttggtccctaaatttgaaatgttctcaaaagcctaaatgcagaaaaaggctaagaagattatatgaagagaaagatctggtttgatcaaagactttggctgtgaattagagagggttttatagttttgggataaacaatttagcaaaaccctgatattctttcttccttcatgcatttatgcatttaactgtttgttaaaatactcctatgtgcaaagtttgtcctaggaagtgggaattaaatattgaaaactctctgttttcaatagctccaaaaaccacataactggagctttaggacccatcttgtggctcctggaaaatgaattttaaattgaatcctgagagattagtaggagttatctaggtgaacagagaagggtctcaagtgaaaaagcttccagggagacagcaatgtctgcagaagtctagaatgagaagacgcaggaccattctaggagttccgagaagttgatttggtgaaagcaaatatgttaagttttgaaaaaggacatggttgacataaggcgagaccagaaaaaaaatttagaatgttgaggtgaaaaaattatactgtattagtaattagtcccagaatccctgttaggaaggaagctttggttacgaacatatcctaacttttagtccagaggcaagactaaggagagtataatgaagtaaagaaaagaggacgatgagttgctctgcattggaaatgaacagggatctatggtttggggacactggaaaaatgagaaaaggggaaataaaaaagcaggaataaaattataaagggaggacaaaggaattataaaaacatggattttaagttatttgtttcactgtgttggaaatgtccttttataacaccctaataatattcagtactagctaccacaaagacaaaagagagaaatgcatttgtagtgttttgtttttatttgtggaaatacaagttctatatctgttgtcatatcagggcaatgatagaattgcctgtcacggtcagtacgtagagtcaaatgttattcagcaaagagaggatgactctagcacttgcagaccccttggagatggtatgagacttttcacagggcagtgtgcagggattggagccaatcttctagttcaaaggagcatggagttccagcaaacacatagggtatgtagaactccagaaagtttgagactgatttaaggataatgggagtgttaatgagggtaatgcttggctccatttgtcatctggatacactgtaccaatggctgagagggaggcaggactgaggcagagaggccagttaggaaagcaagtatgttgggtcacttgcaaagccaccattgattctgatgttctgggatggctcccctgactgtgatctcagttcacctggttccaacctggggacacagaccaagtacttagaccttagtcaaagacattacccctgtcttagaggagggagtgatagagttgggtgattatgtgtgtgtttgcatgtatgcattggaggagtttataagcataaagggagcaagaaatatcaacatggctcaagtggttattcctctaagaccatttgtgagtataaaattgtgtgtgtggttacccacacaataagaaattgatgagaacttaattgaatcaaattagaaatttactagccccacattctgtaattctgccctggcagaaaaatggacctaaattcagactatcggtcttaatatgcatctaatgaagaagtttgaaataaaggcaatctgctgacttgggtgctttgaaaaaagaaaggactcaagttggccattatttcttgttaatcaacacagtagttaatgaatataaaatttacatccttgttacagtaacatttaagttacatctttcaacccattttgtatcttgttatcactcagttttgtttctgtctaaaaatctacttgctagaagggaaaaagagcctttctataatattagaagatttatttaaatagttctaaggactatggactgtaaacttaaaattaataatgtttgccaaaggaaatacctgtgttagaagacttgtgaaagaaacctttgttctttcacacaagagttaagtgtagcttgtcataggaggtggattttagccataaatcctagtgacactgatatcatcaatcgagtcctaagtaactctacctgtataagaaaatcatgattttattaaaattacaatggtaactaatgacttccacagtttcccacaatcacatcaggcctttacctcccttagtctacttgggctgccattaactaaataccatagaatggatgtcttcaacaaaagacaattttttttttttttttttttttttttttgctgttctggagcctgagaagcccaacatctgagtgctagcatgggtgagatctggtgtggcctctcctgctttgcagatggctgtcttctctctgtgtcctcacacggtgatgagatagagagcaagctctttggtttatagggggaccaatcttgtacaagggacccacctccatgagcccatctaaaacaaattatctcccaaaggcctcatctatcatcacattgaggattagggcttcagcatattaattttgaggggcacgattcagtccacagccctccctctgtgcttgtatcactgctttttcttccttgctgtgaatgaactgaatggtatgggcttttatctaaggacaccctctagccttgtgcataggctctgaaaagttctccttgcacagggacaacattgtcgggacttagccctttttctcctccatgctcaaatttcacttttctgttagatcagttccaacagcctgcacaatactgtaaatacttctatattgaagattaatataaaaacaaaataggctgggtgcggtggctcatgcctataatcctagcagttttggaggcagagatgggcagatcacttgaggtcagcagttcgagaccagcctgaccaacatggtgaaaacttgtctctactaaaaatacaaaaattagccaggcatggtggcacatgcctgtaatcccagctacttgggaggctgaggcaggagaattgcttgaacctgggaggcagaggttgcagtgagcccagatagcaccactgcactccagcctggatgacaaagctagactccgtttcaaaataaataaataaaataaaatttaggaaactgttgaccctacatccccttctaacttactgtctaatttcttcacttttcattagagccactcatctaatgtgtctatattcactatctctaacttcttttcttccattctctcattttttaaaaataaataagatcattatacaaaactcaaacaacataggaaagcaaaggaagtcttgcttctatcactgccccaccaaactcataatacaagccattttttttttttggtttctaatttctaattctttccacttttctaatgcagacatcaatatactgtataggcttgtctgcagtttgtttgtttttactcagatatacccaggagattttcccactgtcattatttaaagaatgagtccccaatccccaggccacagactgacaggtcctggtccgtggcctgttaggaactgggctgcacaggtggaaatgagcaaaagccagcggtgattattatcacctgagctccgcctcttgtcagatgagccgcggcattagattctcatacaagagcgaagcctattgtgaactacgcatgcgtgggatctatgttgggtattccctgatgatctgaggtcgaacagtttcctctcgaaacaatccccaccccccaaccctgtctgtggaaaaattgtcttttccacaaaactggtccctggtgccaaaagggttggggaccactaatttaaagaagttcttcattctttaattttacaatggctgtgaatggtcatcattgattcaactattccttacttgctggacattgggttgttgccattacaaacaatatcctaattaactccttaaacacatggcatttgatatttgcacaggtgtatgcacaggctagactcctagtagtagaattgttggctcaaagggtaaatacatctataatttatttcatacaatactgccaaatttccttccgtaggagttgcaccattttcaaatgtcacaaagcaacatataaaagtatttattttcctgaaaccttgccagctgagtgtattttcatattttgtatagatagatgacaaaaattgtattttcagtgttattttaatttgcatttctattatgaatgacattgagcactttttctatgtggttaaagggcattagtatttctttgttaattctctctctgtccctctctctctctctctctttatatatatacatatatatgtgtatatttatatatatatgtgtgtgtgtatatatatatatatatatatatatatgctttacttgcttttctatgaattgttggttcttctcaatttcttatagctctctatatactaaacaaattatcccattgtctggacaacaacatgcaaatcataaatccatctatattttgcttatcttgaatctggcttcctagaacctttggaattctgggaaaaccccagattcaaaaagagcttagaaacacatattttaccacctcttgggagctaaaagtacagctccttgagcactcagtcatgtaaacatgactacaaaaagccaaaggtacaaaatcacacatcatgagttctttcatcaggtatatccactcagtacccaccatgggtggtcaggtagtgctctaagtatcagagacttacagccaaacacccacaccgtaactcaaggatttacactggtcaccaaattgaagggccagttagtagttaaaaaaaaaatggaaaaaaaaggtaagaaatacattgactggcttgcagtacaaaaaaaagaaattatcctattgctgtgatgatgaattgcatcatctccattattcttcgaatttattgcaatcaagttgtttgcccttatatatactaaaattttctttgtcaagatcaaacatgacttctatgtagccaattctaatatcaattctcagttcaccactaagtgataaatggtttacatgatggataccccagttacccagattggatcatcacacattgtatgcttgtatcaagatatcacataaatgacacaaatatgtataactattatgtattcataaaaataaaatattaaaaactaaatcccccacagaaacttaaggtaaaacgattcccagagtatatgctgaatggtcattatttattgtatcttcaacccatttctgaatcatgcccagctcttatgttatagcacattttcattgcacaacccctgtgtcatcctctattgctaggattctcatttcattcatgttggaacagtgacctaaagagcttaaatgtgccattatcagatctgcaatggagatgaacacttgcctatgcaacatccatctttgtttataataaaccaccatttatattaaaagtgataatcttcccaattaaatattccatatttcccaatatgatacagctgaatctagtcctctgggaaaatttaatctatggtatgttagaagtgatgtgtgggactttaccaaagctctttaaatggaactccttcagctgagagtcatgccctccttgacttttcctctttttgtctttctgctacctggaatgtaagcataatggctggagctccaacagctgtgtttgaccatgagctgaacttgtgagtaaaagctatgttctaggacaggggtttccaaactttctgtaaccgacaaaataaatattttaggctttatagcccacacttgctctctttcatatttttctatttttgcttgatcttctttttatatactcctttaaaaagaaaaataaaatttttaattttgcagtccctacaaatgcagtctgggccagatatgcctgtgagtcctaatttactgagtcaccttactgtaggatggtgggagagaaagattagagagtgcctcatgacagcagagctggcatgccagccctattttgcgtacctccagacttcctttatgagagagaaattaatatccatcggtttaagctactgttactttgtgttttctattatgtgcagataaatgaatcctaactgataaatggccttcgaaggaaatgtacatattgcctctgccaaggaaccttagaagacattattttaaggagaaatactataaatacaaaagcatgtaaataggagaaaatttcaagggcatatttacaagagaaggttgaagtgaagaatcttctctggagggtatggaaagacgttttgataaatattattccattgatatgtcaggtgaagctagttgattgcagtcctgggagtgaggaggagcagtttgaacttgattcattagttaataaagagctattggacgttcttaatcctagtgagggcataagaaagccatcattcggaaggagtcacttgtcagtaatatagtctggactggaacacggaagctctatgctggtgatcctggagggctgaatctcaaaagtttgaaatgacaatagaaagaaaaagttgattctgagagatgttaccaggtaggggcagaatgagtggactagcatttgttagataaatgcatgtaaacgttggcagaggagggaagagttggctatatctgcaggtaataaatttctgctcttataatgtttataactatttttgctcccttgcttatctatctattattttctatattgtacacttatttcaacagaacaattcatgcttcaaccctcgaaaaattgtcattggacacaactttataccacttagctgagtttcctaatctctttcaataaataggtaagcacagaaccccagttgtagctaaagattcttgaatttattcaggtcaatatattgattaagtaataataataataactcacaatttttaagagcatggtatttgacagatgttacagactacatagattctgtgttgtcttcataagaatcctattagatggcagctgtacacagtcagcttcaccttcaatattgtgaaacggttgcttggaagaagctgtctagccaggaactgcatttccctgtatccacaccattttggtgaatgctcatgactggattttaccaatgaatgtgaacaggaatgttgttaatagcttcagggctaaaatggttatgaaagtgcaagagatgctctaaactgtctttctctgctcaaagagattctaggggatcatgaaacaattatttggagacacccaggatcccagagtcaatgcacggaaagagctatgcatgagagccacctaacacatgtaaaactgtgacatacatgagaaatatacattaattcccttaagccactgagatttttgagccaaggctggcctactgtaactaacacagtaggtgttattaacattaccatttatacaaacagaaataagacttgggaagatctgcctaagacactaagtaatagagctgtgattagcatttgaaatattcaatttcagagcccatgttcttaaccattgcccaatatcatcatctttttatataaatttgtaaaagtggtgatactgttttttttaataaactaggaagaaattctaaactcctatattttgaggtgtgttgttcatgttcacaaagccccatagccaactaataaggtaatatgcattactaatgggtaatatgcattctacattaaaaatggcatttgctttaaggaattcaatgatctaggatttaaatattttgttccaagtttaactgataattccccccaagcttttctcattggcacaataatatggcttaggggaaagtatgaaggctgagtaatcagaactgcttggatcagaacatgacctcttcggccttgagtaagacatgtaacctcgctgaggcttcgttttactctctgcaaaagacagttaacatcaccagctttttaggataattctaaatattagaaataatgctggaaatcttaataaatcactcagtacacatagacagtaatttaattcaatcaagaactatgtatttaaatgtctactataatgcatgccagacattgttgaggctccaaagatacaataaacaaaacagacaaaaatcctcacctatttgcattcaatgtattcttttttttttttctttctaacagttcataataaaagaaaccaatattaaggcactttcaattctgatcaagatggagtaacagggacaagatttacattcccatccgaaacaacaacaaccaaacaggcaaaatatattagacaatagtttaggaaacactggccattaggtaaaatagatagtgatctcggagatacctggaatgaatgagatgagccctacaattgcccaagcaattatgagacaaggaagaatgcaaaatgagattggaaaatattttaaataaaaaataaaaacacatgatatcaaaatagcaggattctactaatgcaatatgtacacagaaattgaatcactaaatatctatgttcgatagcaaaaaagatatcaaatcaatagccttaacttctaccttaacaataacatttaattagaaaaagaagagtaaattaaatcccctgtaagcaaaaggtaatgatattaatcagagcagaaaacagtaaaatagaaacagaaaacaatagaaaaaataaatgaaaccaaaatgtagttcttttaaaaaagtcaatacaatcaataaacctctagccaggctaatcagaaaaaaagagagaaaatacaaattatcagcatcaagaaagaagggacataactacaaatttttctgatagtagagaataatatagaaacattgtgaaaaaaaaacacgcatgtgaaatgaacaattttcatgaaagataaaaacaaccaaattttactcaggaagaaataggtactctaaataaccctgtatctgttaaacacattaaagttacagttaaaaaatttctcacaaggaatgttctaggcccagatggttttgccttcgattctaccaaacatacaacggggagattatacaaattcaaagcaaattcttcctgaagacaaaagaaggaagacttccacaaatattctatgagccagcattaccccagtatcaaagccagggaaaggcgttacaaataaaaaaaaatacagagtaatatctctgatgaccattggtgcaaaatttctaaagaaaatgccagcaaatcaaatctaacagtgtataaaatgataatgcattatgatcaagtggggcttatctcaggaatgcagttagtttaactttagaaaatcagtgtctgtaatttacaatattaacaaactaaaaaagtgattatttcaatagatactgaaaaagaatttgacaaaactgcaatgtgaattcctgacaaacactctcagcaaatcaagaacaaaaggaaacttcctcagtgtgataaaaagcatcttttaaaaacttacagctaatttaatggttatatttaaaaaacttaatattttccctctaatatcatgattatgagaagttatctactcttacctgttcgaattgtatagtgcagattctagccagtgcaacaacaaaaaaaagaaatacagtattgagcatgaagaagatatatttatttaaagatgacagaactgtctatgtataaattccaatgaaatctacataaatatctaatagaaataattgcatgcagtgagactgcagcatacaatatcaatataaaaataacttccattaaattgaaattaaatattatttataatagcttcataaattgataacttagtaaagttatcaattttccccaaattgatttacagagtcaataaaatccaaaccaaactcacagcgggcattgtttatttggtagaaatcaacaagctgatttgaaattaatgtggaaatccaatgaatctagactagccagggaaattttaaaagaaaagaaagaacaaagttggaggaataacagtgccagaattcaagactgattataaagctacaattattaatatagtgtgtgtcattggtgtaataaaagacaagttaatcaatggaatagaaatggacccatgaatatgtagaatattgatttttaataatgctataggctaagcaatggaggaaaatatcgtatttttagaaaattatactaaagatatgtttgagggggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagccggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaaccatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaactaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagttttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagccctcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaatcatatgtttgaaagcatcaaaaaaaaaaaaaaaaaaaaaaaaaagaaaattatactaaaaattaggtattcaaatgaaaattatttaattcatacctcacaccatgtacaaaaattaactcaaaatgcatcatagatctaaatataaaatgatacaacttctagaaaacaaggaaaaaaatcttagtactcttggattaggcaaaggttttctagatatgagaccaaaaacataatccataaaaaaattaagtgggactccattaaatttgaaaattctggtcttttaaagacactgacaggaaaatatagttatatagctaatatgggggagggagtggtatggattgaatgtttgtgtcctctctaaaattcatgttaaaactaaatttccaatgcagcagcattaagaggtgcggcctttaagagatgacttggccatgctggctctgccttcatcaataaattcctgccttagaaaagtcttgagagcgtgagtttacctctactgtcccttccaccttgggaggacacagtatttattcctctggagcatgcaggaacagggcaccatcttggaagcagaaaacagcccttaccagacactgaacctgcagacaccttgatcttagacttttcaacctccagaactgtgagcaatatatttatgctatttataaattacccagtctaaggttttttgttatagcatcacaaatgaactaagacaggaagaggagaaaacttgtacttagaatatgtgaagtgctctcaaaactgaataataagaaaataaacaacctatttaaagaatggacaagagtttgagcagacacttccaccaacaaagatgtacaaagggcaaataagcacaaagaaagatactccatatattagtcatgaagaaaatgcaaattcaaccataatgagatactgttacactcctggtaaactgactaagttaatattctgatcataccaagtatggtgaggaggtggagtgacaggaatgctcacaagtgctagtggtaaagtagtttatctgtcttctaaaaagttaaacatgcacctacaatatgacccatttatcttactcctagggatttactcaagagaacagaaagcatatagacatacaaaggcttgtccacaaatattcataacagcattattcataatagccccaaagtggaacaacccaaatgcccaacaagaagtgagtggatggcctggtgcggtggctcacgcctgtaaacccagcactttgggaggccaaggcgggcggatcacttgaggtcaggagttcaaaaccagccttgccaacatggcaaaaccccgtctctgctaaaaatacaaaaattagccgggtgtagtggcaggtgcctctaatcccagctacttgggaggctgaggcaagagaatcgcttgaacctgggaggtggaggttgcagtgagctgagatcacgccattgcactccagcctgggggacagagctacactccatctcaaaaaaaaaaaaaaaaaaaaaaaaaagaagtgagtggatggatggatggataagcaaactgttgtacatttctataatggtatactatttagcattaaagtggaatgaaatattgatgtgcacagcaaaacatctcaaaataattatatataagaagccagataaaagggtacacattgtgtgatcctatttatgtaaaattgtcaaaacagaaaaaaacccacaacacctcatgtagaaaacagacccatgttttcctggggaaggtggtgaggagggctgggagaaacaagagaaagttccagggatgatagatatatatgttcactactttgattagaattattttacgagtctatacatataccaaaacttagatactttaaatatgtacaatttgttgtatgtcaagtatagcttactttaaaaatgtaaaactataagacaaaaagaattatcatttagaattttttactgaatcaaaatattttgcagatgcatcgaattctctgcttcctatcatttagtcaaccatttgcagaggcctagagatagttttggcatggaatagatagtgtcttttcatttagcatggctaacatttaacttaaaaattgtaaagatactaacagattagaagttaaatgcttattcgctgataacatcttcaacattgagattcaaagcattgtgccccttaaagattagttcaccactggccatcagtagccacttttatttaattatatttataaaatttaaatgaatcaatgctcttgcctaagaaaattatacccaggagtacagaatgaaaaatgaaagtcctcctgctcatttttcatttctaagtacttcttcacgattaacaatgagagcaaggttgacaaagatgatgaactgccatttctaatccttcctggcaattgcattcacttattttcttttgtgaacaggaaagtacttggagagaaattatacagtgattcatggttctggggaaggctgctgatattttgatcaggccacctcagtgccctcaggaaatcaaagtgtcctatcactctgtatccattatcattacaaagatggtctgcttttaaaccatcttgatttccaggtagtaaatgattttttaaataaaaggtgtttctaaaagtattcatttgtactttttcttcatcaaaagagtattatttttattttaggaaagaacaactggagagaaagagagaaaggcttcttgcatccccattttatttgcttttaatcgttgcctttaccccaggcttcttggtaatgtgatggtgttaactaggagtccttatctctggggcaatgaccacaaaaggaaagtttagtagtagtgtcagggaaccacaagtttcagactttagtagctgtccatgaagattgtttagctctatccaacactttctgcaacttgatggccatagtttcctgagtctgagtctttagtgcaccaaaaagaagtatccatacctggaaaagtttctgttaggcacaggtatgcagattctttctttaaccataggctagataggctatggaaatggatatgcaaataaaggacagctttaccgaaactatctaaatttttctcttatatccaaagatctgttatcctagggtagctggagtcctaatttccaaaattttcagaaaagaactcaacaaccaaagaaagattagggagataactagtatctactgagtccccactatatgctcacacagaaacttatatttgtaaatcttatatctcaaggccacattagtctggaaaaaaataaagtggggtcaagacaagaactagcaacagcatatctgcctctgccttcactgtctcttgtaggatctctacactatcttctttaaacatgatttgctagcagttctgggagtcctctggtgtagctcaaagatgctcacagagagcatcctctcagtatctcgaagcatctgccaattccttcctcctggcttatcagtctttgatctatgacggctatcagacctgctgaaagtcatgaaacagctaaactacttccactctgccaatagccctagggatgttgcattcacaggtacatttatttaaaaattctccctgtgaagagttgatgtacgtgcatgttaagtcaacctatagctacagctttgaacagttatggctctctaatcaggaattaaaactctattttgttgttgttgttgttgctgagacagggtgaagtgcaggctggagtgcagtggcatgatcatggctcactgcagccttgacctcctgggctcaagtgatcctcctgcctcagcctcctaagtagcgaggactgtaggttggcaccaccatgcccagctaattttttattttgtgctgagacggggcccttctatgatgcccaggctggtttggagctcctgggctcaagcaaccctccctcctcagcctcccaaagtgctgagattacaggtgtgtaatctcaccacacccaggctgaattaaaactctagagatggttacttaagcacttaatagtgttatcagaagttgtgccagagggtttactggcaaaaatagatattagaaataagttttaattgagtaaatgaggttctaatgctaccaaattcagtcacagtcttggaaattctctatttggttttgtttgggtttcatatgtatgtagtcatactttatatttgtgtgtgtgtgtgtgtgtgtgtgtgtgtgtgtgtgtgtgtgtgttttatagtgcagccctctccttaggcttctgatatgagaacctgggcctgaacagaaggacatcagaatggttcgtcccaattagtactcaaacactcccagcctttggtcctgattttctgtattcacaatcttttgtgcaatctctactttgtattaccttaacagagttatttcccataataatttcttttctcttaagctttagacctctgttaggcccattctataatgcccacacatgtttataccaaagaagaacactcctatttctgtggaaagacaaattaaacttctgtctatcagagccttagtaaatagaagttcaaaaagcagagtttttataggaaaagaaggaatcttgagattaaagtgcattcaaggaaacaccaaattatatttagtagagctttaccagagatttatttttggaaattgttctgatagtcaaactagatagtagattccccattcacggagttctatgtggaaatactcaaaattataggttaagcatggtagatctttcattagcatcaattttaccaagctatttttgccaggataaagggaagtatttttatataagtaaaaatagtgtactactgaataataaacataatttgcttcggtttctaacagaagtctttgaagaaatgttgttttcttggttagccatttagtgtaaggccccagacttttctggaaaatttaggtaagcactaaaaagcaatatttgggattgtcagcaaacattaaatcactgtatctaaatatgaatcttctatattttaattttaaccatgatccctgcaatttgaagtgaggtaagaggaagagaaggaaagatcatccattttaaagaacaaagaggccaaaacaagcaatatcataataaatgtagcatagaattatagagaaacctgaattgaattacattgtgattgctcagtattatatcacagtcatatgtattttaagatgaattgctggggttttaattaacatgtaggaaataaaacagtggaaaataattttaaacatatttataacatatatgataatacacctgcttttaataagtcagctgaattacatttttgtatgtaaaagttaattttcctatttcatagatatggaagtttgatttgttttctaatttttctttaactccttgcattagatgaatcctatatctccaagtactatatttagtcaagtagatttcctttttaagtgaaaaatgggttttgagatagaaaagagctttgccttaatatgccaattatacagctctttttaactctaacttgtagtctgagagatggtaagatttttcagttcagttgctctcaacaactgagatattgactgactcaagtttgagttacaaataaatctacataaaaactttcactttattgattcttttcaaaaacttctaattatgctttcaggtggttaaatggcaaaatctaactgcatctatgacaaagtgagctatattaaaactgtgggataaaggagaaaatgactactaaccagtgggcaactgtcaacaatacttccctaaaacaactgttgacaagctgctagacaaatgtcaacttagatgagttcaataaaagtagatcctgcagaatgagagggagtccctgtgttggcagagaggagcctgtctttgttagagacagaatactaaaactgtgctgatcttgggtggctgtacccaagaattcatcctttcactggacagtttccaagttattgtactttataaaataattggcattatcatgtttccatatactaagtcaatataagtgcattttcagaacagcgatgggatcagatttcactcagaatccctctgtcagaagaatccagaactcacaaaatcctattgttccaattaagaacatggatttgggaacacctggatttgaatcctgcccttctttttagcttggtgaccttggccaagtcaccaagtgatcctttatttgtagaataggaatagtcatagttagctccatgttgcccgggaagaataaatgtagtgacatgtgtgtgagatcttagtagagcacatggactcagcacttgctcagttcatggtagctctcaacagcctccaagacacaaggagtcagctgacatttctataaatacttgtctcagctcttgggcaagtgggaacttgtgttctacaaactctgatcattgaatcgataggatttcacttagcatagttctttaactttcctaggagccaacatctactgagcacttaccatgtaacaggctctattctgatgttgttttgttttgttttgttttgagacagagtctcactctgttgccaaggctgcagtgcagtggcgtgatcttggctcactgcaacctctgcctcccgggttcaagcaattctcctgcctcagcctcccgagtagctgggattataggtatgcgccaccatgcctggatggctaatttttgtatttttagtagagaaggggtttcaccacattggccagtctggtctcaaacacctgacctcaagcaatccgccggccttgacctcccaaagtgctgggattacaggcatgagccactgtgcccagcctattctgaatgttttaactgaattaatccatttaatactgatatgaactgtgtgagatagaaagtaaccttattttacagagaaaaataaaattatgttataggattgccttgtattgaaaaactagtggggggaagagatgggattgaaatgaaaataatctaacacataaacttgtgtctttattgctacttttattgcctctcctactgagatgtaatgtccctaaggaaaggatgattttgaatgttttgatgtcctccaagcacttgacatgttgtcctggcacagcatgcatgttgttctttagggatctcccaatttatttgaggagattcaatgtgcaaggatggtaaaacataatggcatttataaagccccactctggtccaagtattggattcggtggcttattggcctcattttatcctcaaactgactttgaaccataggtgtgcttacccttatctataagtcaatcaggcttcccaggtatcatacagaccccactccggtgtgtttaaacagaaatggaattcattaaaggtagttctgagaatttctaagtgagctggagcatcatactcagatgattcttggtcaagttcagtgcccaacctcatccccaggactgcatacggaagcggcactacagctcgtatggctaacgctgaacattgaaatcactgacactgtttttcttggcatctgctggctttaccacaacccttgccaggaaatagattctgtttcctcacttccaaattgaagtcttccaagagcgcatctgattgatggaggcttaggtcaaacatctgccttaactgcaagggaagctgaaaaaagtgtgtgaatttaaattcagagaagcaagacttgtaaactgagggaatttcctgattacaggaaagatattaaaaagtgctaggtttgggggaaaaaaaaccactttgtaaatatccactacacttccattttacagatgagaagactaaagctcataggttagatcactgagtgcatatcacgtgagtagtaagcagaagactgagcatatagaggcagacctgtctccccacacaaagaaataacaaagcgatgagaggtttcaacagtcaatagcagagcagttcaggggaggaaggctcccttccgggtgcggtgatcacaaaaggcccaagcaaagtaacatcatttggacagctccctagaatcctcatctcaaggctgtaagaaaaatcttaggaatgatttagtgcacattcttcattccacggaggaggaaactgaggcttgtagaaaagaattgctctgcccaaggtcatagcctctttgtggcaagtagctgaaaacccaaacccgtgacagtaggtccagtgctctctgcagcaagccgtggaccccacctgctaaatcacatctctggcagaactgtcgggcagactttctttgaattgacaaacagaatgggagagaaagtcacgtgcttcagtcaaagcaaaaaagaaaagcttttattctgtatgtggtttctcatagaatacttctcgcccagctgcgcccaagtaggtaaaaggctcttgcttatgctaaggagcctttcttatctctgcacaccccactcctttcctgctaataccaagtacagaaggcaatgaaagaaaaggtcacctgccttcctcctaatgggacactgatgtttttaagtgctcacgtgatctgtcccagaaaatgtcaaattgttcccttataactctaagttggcggttagttgagtggctctgttgtccagacaatggatccactcaatttttgcctctcatttgaacacccacatttaaaaaaacttgggaagaaaataatggaaaagttgacctctcagttttccggaaaaggtgaccatacaaatgtgtcttttctggctgtaggctttatgaaacttctgagaagaagcgtggtattttagataaaaacaagggtttggttgttagactgtcctgtggttgaaattcagctctatccttgctggtgtgtgatcttggacaaaagacttaaacttcctgagactcagtttgtatgcaaaatgagaataattataaatttgtaggggattagaaataatgcagattcttgacatttattatggacttgttatacatgaaggattattagtttcactctttatttcattaactactttgacttaagctggtctctttgatgaactttcattgactctctggtacttgacatttgtataatattactttcaaaaatgcattagtaggctgggcgcagtggctcatgcctataatctcagcactttgggaggccgaggtgggcagatcacctggggtcaggaactcagatcaagaccagcctggccaacatggtgaaacctcatttctactaaaaatacaaaaattagccaggcctggtggtgcatgcctgtaatcccagctacttgggaggctgaggcagaagaatcacttgaacccgtggaggttgcggtggaccgagattgcaccattgcactccagcccctgggtgacagagcgagacactgtctcaaaaaaaaaaaaaagaaaaaaaaagcattagtaatatgttaactcatattattttcagcaagctttttaaaatatgattttgttacttttttttacagataaggacactgcattgatgagtccttaagtaactggtgaccaagatggccttaatgtctccctcagcttgactaaggtttacataggtttctttttgactctaggccactggcttcttttttcttagataatttacttaaaaaaaaaaactctgcaattgtaaattatttctctacaatctagagatgtctttctcaaggatttgggactaatttccttgaagtcatagaagaaaataagatgcctatcttcctatctttgggagggtagaggatccttagacaagtgacagccaatacaaatggcctaatcacattgaccaactacagtagtcctcccttatccttatccgtgagggatatggataattcatttcagtaaatgcctgaaaccacagatagttctgacccctatgtctattacacacaaatttctttttccttcacaatttcgtggatagaagattcattcttaccctagattttagcaacttcagcatacgatttttttccttaactagacaactttcaccttttcacccaaaggaaatactttatggcttctcattggaatattcaaattgccagtatcactactcttgtgctttggggccatgattaaataaaataagagttacttgaacgcaagcactgcaatacttcacagttcatctgataactgagaagactactaagtgacaaagggaggattcatgtcccaagcaggaaagagtgggccagggtaagattttgacatgctacgcagaatgccatgcagtttatgacttataaattgtttatgtctgggattttcctttaatattttagatggcagctgaccacagataaatgaaactacagaaagggaaaccccaaataagggaggactatggtatacctctaccgtcttccagtacttttccattagctcatcccagagtttaaaactcccatttgtttttttttagagttgtgttcaccctttctctttcccattgcaataatcttgacctctactgaaatagtccagaataaaacctttcttgcctgtctaacttgtctgaggcaatttcttttacactggcccaaagtcactgaattagacaaggtaaagctaagatttttagtcaagtcatttgtgtttttctcatatggacttaagttgggctttaagaccaagactgcagaccaaatttttattctaagaaaggcattatcctggaatcacaatctaactaaaacagcctttgttttctcctctgaaaagtgagaaagctggactagattcctgtctcacagttggatcttggagatccttcacaagccttgatggactagggaagaggggaccaaaagaggcctgactgggggctccacaatcatgcatgcttaataaataaataaaataaattggggccatatgttgacctcatcaagaagggtggatgctgctacaagtaaaaaaatggaaaatcactggattctaacatttatatggcctgttctagctctatttattttttatttttatttttgtgatggagttttcactcttattgcccaggctagatagagtgcaatggcacagtcttgactcactgcaacctccacctcccaggtacaacaaactctcctgccttagtcacccaagtagctgggattcaggcatgtgccaccacgcccagctaatttttcctatttagtggagacagggtttcaccatgttgctcaggctcctctcgaactcctgaccttgggtgacccacccacctcggcctcccaaagtgctgggattacaggcatgggccaccatgcccggccttgttctagtaacactagctccttcctaggacatcaaaacaaatccagcacacctgtcttttcctcagagcctgctttcaaagttttatctatctcacatgtttacatgtttatctaatactgttgctgataagcagatattcagtgagtaggtactcctcagacactatctatttacattttcattaaacaggatctactttggagataatttccaagtcaaaaagaagaaaagcacttaattgataggaattccagatccctgaactaggatgacaggtgcaattggcttattcactcaagagttattgaatgcctactatatataggattcaaatccctgcattgtgtagggatttcaatatagagttaaaaaaatctggcccgtggagaatacaatctagtaaaagagatttgctatatactcaagcattctcaaaatcctaaatttaaggaagaagaattgctgatttagctttttggagttttaattcaataagaataaacacaaactatgctcaaggtatcttaccaaaccatatattacagggaataggagatgagattcacagaagcaggaaagattgtttacctttatatctcttctctccttcaactctctacttcacacctatcttcttcatagcagggctcaaaacatggctattaaatgcgtaagtaaatatttaataactacttcctgcattaaaattatattacatttggcaaggcacagcggctcacacctgtaggggtcgcagcattctgggaggccgaggcaggcaggttacctgaggtcaggaatttgagacaaacctggccaacatgacaaaacccggtctctactaaaaaacaaacaaacaaaaacaaacaaacaaaaaacaacaaaaattagccgggcatggtggtggatgcttctcaggaggctgaggcaggagaatggcttgaacctgggaggtagaggttgcagtgagctgagatcatgccattgcactccaggctgggcaacagagcaagactatgtctcaaaaaaaaaattatatatatatatatatataaaatataacatttaaaaagaaaaatttaaacaaagtttgcaataatttatcccccatgttttacaggttattatacttttccaaattaaattcaggattcaactgctaatcttggcttgagcaagacaaatctattagcatgccccaggcaggtttatcaaaaacatctttttactattaaagcctcaacctacttcagctacaaatccctgcagacttacttagcataaggcactatcatttctatcttcattacaacacagtttaattatctgccttagaaataaggttcttcctcttaatgaaagtggttagtctggtggctccaaagggcacaaggcagtttcaaggcttaattctgattatatatgcaattacaagttagaaaatatgcttgaaagtcaatgaaagttctttcatctatttctccagttagaaaacataaacattggttggaacgaagattttgttgttgatgttttacttgtctagagcattgcttttcaaatttgaagatggcgcttccaggtgtcacttagtgtcatctgatgtcagttccatcgttactggggttcacatgaaggtagtggattcacagacctcagtttatttccaggtatagtaaccatgtgtccaggatagttatttaagtcccatgggtttaactttctcatctggagtcctactttttggggttggtgatgatatttaaggaaataataggcatgtgattggtgagaatgttagctagtaattatattacttcacttaacttctcccttccaaaactgcctattctaagtgtttgcttcctcctgtcctgtcgtcagccatatttctaacatcccattctcatctgaggaccatatctcctgtgtcactgagaaaaggagtcaccagagaactccttctagttttctgtcttctaacaccaaactttttttttttttttttttgttttgagtgtctcattcattgctcaggttgcagtgcaagtggcatgatctcagctcactgcagccttgacctcctgggttcaggtgattctcccacctcatcctactgagtggctgggaccacaggttgcaccaccatgcccagctaatttttgtgtttttagcagagtttgggttttgccatgttgcccaggctggtctcaacatcctggactcaagcaatccacctgccttggcctcccaaagtgctgtgattacaggcgtgagccaccacgcccagcaaacatctatattttctattatctttccttctcccttttcatctttaaggaatttggaccccatattctaagactcatttctcagcctgggcttttgcccaactcatttgaccttcatccagaccttctccatcatttttccttgcttcttttagtgaaaccttgcactttctgctcactctggttcatttccctcagcttcaaacattgagatcatagtagccagattcagttcacaaagcatccttcacataaagttttgctaaggaaataacaaagatgtgtacaaagatttttgatcaaggatagccattgtggaaatatagtaggaagcattggaaaatgccccagtggtcaacaatataggttagctaaataaattagggcaatattggttagctaaataagatggggtgttttagaaaaatagaaaatgttatgggaaattctttagtcatgggtaaatatgtcaagctggtattaagaatcatataaatgcatgtgatgtctgcaggcaggcacatgtgggtgttatgcattgaaaaatgcatacatgctatttctggcttgtgagatacaggctaactttaattttctttgaatttccttgtattctctaaacttcatacaaaaaaacttattttctttctataataggtgagaaaacaatgttttttaaaaaatgcttctttgcccttgtgtcctttcaaatgtcaactcatttatttctttctcttagctatctttctccttaaagtacagtttacataagctacctccttccacttctttcctgattatttacttttcaatctaatgccagttcattgagcccccatcatgggtcatgcactgagcaaagcacagagcaagtcactgaggatacaaggatggtggtggctgaaaaaataatgtttttttccatcaagagctttaacaggctgctaagaaatgaagtactctctccgttgaatctatcccaagaaataagtccacaaagaccacaaatataccacaatgtttatgataacaccagtttaataagtacctaaaaatgtaattactgaaactctcataaatctcacttctgcatcattccaaaatccataaacaaacacaaaaatgctcttaaagtaattccagattaataacatgaatcaagcttctagtactagagtttatgactagaatcctaataatagtttttcattgatgttgcttaaaaataagaaaaaagattgatttatagtaataacatagatataaatatctgtatccctagagttctgctttgcaaatattaaagaatttttttatggtgagaaaccaatatacatttattagataatacttgccaataagtaaaaagtaaataaaataagaatcacacatatatatgagtataaattaatcattttggagtggaatttacagcttcagtttttacagatagtttctttctttctttcattatctgggttaaacaaaggaagaagaaactactgttggcaagttgcaatggcttctttcctctaatgtttatatgtgtgtgtgtgtgtgtatttgtgtgtatatataatatatttagtatatttgtgtatatatatagtatagtgtatttgtgtatatatatttgtgtatatatgtgtacatttagtatatatatttgtatatacatacagacatatatatataaatcttatccttatgtagtgaatacaatactatgtgaatacactatgattatgaagtgattatatagtaacattctaatctcctggttatgaaaaaaatacttaaaagtttatactgaaaggggaggatgtgttaatctgttttaagtttaggctacaggcagaatatgacttctcccaaccaaaggcaacattcttgctaactttagtatatgttaggtttcaaataccaagaacagaacttggaacaacatggacatttacagggcaatcacagtaaaacctgctgcagtagaggcacctcagatggatgcttaaccagccttataggtcaggaatatcctcctgagggaaatagcataaagacatttaagctgagtcttacaatgttagctagtctgagaggaaaccaagatagggtgacaagtttttttttcccacttaatatcatttgattaagtgtccttgatttgattaagtgtccatgcttggctccaaacatggaaactgggaagctaaaaaatagtcattctctagacattaaagctgcagcttctcttaaggctgattctcagtgatattttagctcttgatcacattaccttaccgggtttgatcatctctaagattctactataggtgggagtatcacatggattgcactgactttcaggatctttggattctcatccatacgttcatgcatccatccatccatccatccaaaccatatgtactcatatgttgaaaggggtcatggttgataccatggtataatgagctgtgaagcttctccatttagggagtttttcatgtaataggtagggctaagtcgagtgcatgtggcaggcacaagcagaatctgcagaagttctgagagtccatgtaatcgaaacagtctcctctttgacaacaaggcagtttttcttctgacttcactgcattcattacataccattactacagatactgtaattctttcctttgggcctttaacattctctgtgggaacattatttatcaaagagtaaaattttgaaacttaataaaacaaacataggagagattcatgactaacactggtacaatagtgcccttgggtcaaacatttgctttactaaaatgccaaacagtctccagtttctaccaataaaacatgacttcatttgctttcagcactgttggaatgcctctactatagcccttagtcagaggagatataattatgactatagcttcactgatattggatgttataagtggacattcagaccaattagaaagaggaatgtctgggaaagaacagtcaagggaaggaagactgttggccttgcaacaggagacctagccaagggtatttgacacattagatgcaggatgcctagtgaaataccttgagaaacaatagtgaagctatgaattggaaggaaacatttcagcagaagcaatctgaatgatgcacacgatcatatcattttcttgctcaaaacaacccagtgattcctctttggaattagaataggtctcttcagggggactgacagcatccttgcagtccagaccatacattttctttttccttactttcaacttttcctcttttccctccccctgtcctttcctttcccttcctttcctgtctttcttttcctttcctttccttctaataatacatttaaggggtacaagtacagttttgttacatggatatattgtgtagtcatgaagtatgggctttccatgtaaccatcacatgaatggtgtacattgtacccattaagtaattttctcatctcccaaccccctctacccttccagcctcacatccttccaagtctccaatgtctattattccattctccatgtccgtgtgtacacattattttcaacttcatctattccatattatcttcttaaagtgttttaaaaaattatttttaaattgttaaaatagtatatatagtatatatttatcatatgtaacatgatgttttgaaatacgtatgcatcatggaatggttcaagagagataatttacatatgcatgctctcattttttgtactgagaacattaaaaatctactcagcaattttcaaaaatatgttattaactgtagtcacattgtttgcaatagatctctaagttattcctcctatctaaatgaaaatttgtatcctttcacttacatctaacccaccaccactcccagctccagaccctgttaatcaccgttttactttctacttctataagatcaagtgttttagatttcacatatatgtgatctcttgcagcacacgtctttgtgtgcctggcttctttcactaaacataatgtcctaaaggtacctacatgttgttgtaaatgacagaatttccctctttttaaaaggccagatagtattctattgtgtatatgtaccacattttatttatccattcatctgtcaattgactccgtagtctagccattgtgaataatgctgcaatgaacatgagtgtgcaggtatctctcttcaatttattttttttcctttggatatatttattttcctttggatatatacccagaagtaagatttgctggatcacatggaatttctatttttaatttttggaggaactttatgcagttttctgtaatggctgtgttgtttttgttttttttttttttggtttttggagacagagtcttgctctgttgcccaggatgaagtgcagtggagtgatctcagctcactgcacctctgcataatggctgtaatttatatttccaccaaaagtgtactagggtcctccttttttccacatatctgccagtacttgtcatcttttgtctttttgataacagccattctaacaggtgtgaaatggtatctcattgttcccccccattcttgttccctgatttccaattgcaggtcttatccttctgctccttaagccttcccaggcattcctcttgccttggaacttgctgttccttctacctgggagtcttttctctgatctttacaatatggattctctcttatgtagatcttagctctaatgtcatctcttcagagatacttctggtcaccctgtctacagcagcccctcctttcctctcccttctcaggccatcactctctattcctttgcaataattgattttccttatatcgtatctcactaccaaaaattgttgtttattaattttcttgtatattgctgcttgttttcttatttattgacaggcagtacaaagcagtggttaaggataagaataaactccagagtcagcttgggtttgaatcccatctctatcactatgcaggtgaccatggcaagttacttaatttccctatgtttcaattttatcattaataaaattgggataaaaatagtacctgcctcataggattattgtgagaattaaatgagccaatcagcataaatcacttagaacagtacctgaaacatagtagcactaaataaattgttattattatttgtcttttacattagaataacagtaagaatcttagccctctagttcaaatgctgaattctctagcatctagcatagtgttttgcaatagcagatactcaatcaatacttgaataaatgttttataggagattgcctagaggaggagaagaaattttcaggggactagatctgaaaaagcaatttaagtcacagatgaaaagaaattcgctattacgtaatgaagacgagagatgggaggggttgttagcacaattagctgtaacctggtattaatgaggccaaggtgataggtttggcacttttgtgtgttccacttaggttcgttctctgccatgatcatttgttctgcatttgtatggctagtcagctgtcttatgcatcaatgcccacaatcaggaagagagagaacaaagaaatacatttatcaattatggctaaggaaaatccatctgaaagtgtcttcctgataaacagtggtgattcttggtgttgtcaatatggcatatttcagtactagctctctactgagttcaaaccacctagcacaggtgatctcatactaataatatttccagtgcttaaacaaccccctcctgagatggaagttgggtttgagaaattaggatgagcattcccaatttcttctcccttcctgaaatatttttggttgccaccaggtggtactaggtaagcacatccgaacaggacaatgtagttttattatacaaaagattgccaagagttgcaaaaaaattcctacgtataacttctagaaagattactattgtataagacagaatacacttcacttttggtttagacttttaaaacaatgtttcatactatctaatattcaaattgtgctaaggtttgggagaagactccatcttcctatgatgaacgctttcattttggagtagcttttgtcttaagcaggaattaaaaatcctaagtcatgacaatttcaggtctccagagaaagccttctcattttcccttagaaatttacttggaatttcgtcaggagttttcttcccctccttttcttctttatcttcctcttcctccttttctgctcattctcctcctcctactccctcttcctcttcttcctctctgtcctcttcctcttctttttcttcctcctcccttttcttcttcttcttcctcctcctccccctcctcttctcctttttctctttttccttctccttcttctaatctcctattttccttctctgcttcatagacacgtgcttttgcctgtcttagtttactcatctgagaaatggggctagaaatacatgcctaactaggttctttaaatgtgaaagcatgtatttgagtgagtagtcagtaaaagatagcttgtctttgtcatcatcattctaatggacattttcaactaatccttagggtcaaaattattccagttcattttctttatttgataggattttaactgtctttttatccatttccataattggcaaatgagttcacatgaggcatctactgtatcagcatgcagctatgagaagaagcatcagaaaaaataattgccactgcctgggcacaaatttttccctccctgtcttaacaaactgctttatttctgaccccttaactacagtgtttcttgttcaatgctgagtacatcttgcaaaccaagcttgaaacacagacctgctctctatcctagagagtaaccttctttctttaatctgaaacataaataacctacctcttatttccaggtgaatagctgtctatttctatttgactttctgatcatgtgtccacttttccaagcttatatcctcaatatcccttttacaaagatttaccctgtctttccttttcctctgagtataatactattttaagaactttctgctcagaacttttattatcctgaagactacagccaaattgtcataaggaaacagtgactttgtgaaagaagtatgtacttttcaaagctcaactccttgtccagacacatctggcaacacctacaaatactgtcagctaaggctcctgctgtggtcatagaactacagcattatctcagagagtctgtaaagtcctcttattctggggaagtgggtaagaaagtcgaagtagggatggaataagggaaagagagtgtagataaaagaaattctcctgaagagtatgtcaccttttcaagcatctctaagtgaaattggttcagattcctaatcttacatacaattcaataattaaagaagggttaagataaattcaaatcggcatcacttatgcatttaaagaacacgtacaattttcctttctgctttctcaaccctttttaagtttatttgtttatttttgagacaggatctcactctgtcacccaggctaaagtgcagtggtgcagtcccatctcacagcggccttcacctgccacgctcaagcaatcctctcacctcagtctcccaagtagctgggactacaggcatatgccaccatgtccagttaattttttaaattttcttttgtagagacagagtcttactatgttgcccaggctgatcttgaactcctgggctcaagggatccctcatcccaaagtgctgggatcacaggtgtgagacactgggcccagctcaatctttttatttaatagcccaacttcacaggatttagaaaaaatagtcaccaaatatcctattttagggtagcatgagcattttctttttcctgaactccatatgtttggcttaaggcaatgtggatattttctcattttattttattctcagcaatatagcaagaagtaattcatttattttgttaaatctctaatgtatagcttagctgaagtcaataaaagtcaaagttaccattcacataggctatggtccatttctgacaatctcaaaaccatgccatggcacttaaaaaaacctgctattttatatgtatacttaggtttctcattcaaaactaagcaaacatggaattcaaaggaagttaatcatgtgtgactgcagagtggaaataaaatgaaatttctaatggtaacaaatatataatcagatcattaatgtttattaagggcaaagggacattccaaacactgcggcaaattgtaaagtgctgtaacctctaagagtgagacctgctctgtcatcctcactgagatttctacctaattcgttaaaattcatttttgtttattttaagtatgcatacttgccctctgctaggaacagagggaaatgcgtgaaaaggttaatggggttttgattacttgaatgggcagaggagaattccttgtcaggagcacattgcctgtaggtcaaactggttacaataatgccctatggttttagggcatttagattctccttactaattcttcagaatcctcattttttttttctgcaggtatttttctctgcctgcagatcatgcactctctatgctcaatacattctgacaacacactagtcctgctctaattcacctgagacaaaatggcagcaaatacaaaataaccttccaggctggctcgaaattagcataggctctgtagcccaacggccccagggctgaaaactgtaccctttactagacagataactttgggaaagtcactcaatttttctgaacttcagttttatcatctgtcaaatgggtctaactatcaataatgacaattgctgccaattcccagttcatcaggtagatgtgacagtaatatgagaaaacttttacaaatcatgtagcacatagtcaacagatcagtatttactaatactacttaagtatgtggaggaaatgcttgtcatatttaataatttttagttatttatcttagtcatgagttttgattattgacaacattgctccaaagagttttgttttaattgccttacagatgctgtgttataaaggaggacagttttgtgctggagtgaaggataaacacaggggaaaggcacattttcaaagcagcaatctcttgactagccatatcctgctttttactcacttaaacctctaaatccacagctgcaagcaaccaaaggccacaagtcccaaagaagcaatctaatcaaagaaaacattgaatcaaactggcttctctcccttctcctcaactggcatgaaaaatgctaaaggtggtaataataataatatatttaacatttctcatgttttttgtttctaaaacatatggtttcttgctacatgtagagaattgctaagacattcatttcagctttcagctcttgcaaattaaacatacgttgtgtaaaaactactttaaatgaatgatttttgaaatgaagttttaaaaagtactctttgagagatgaactcccttttttccatatatgtatctggatttctttatgtcttttttgagtagcatcccctcacaagagtagcatcccgaaggaaacttcatagcattaaccatcatggtaatagattaattactaatacaagtatttgtttaaggtctaacttattaactagagggtgagatctctaacagcaggggtcctgcctgttcaccacttcatcatcaaaatctagaaaggagctaggcacatagtagaacctcaaaaaagtttggaaaggcagaacaggttgtggtgaggagacagctgtagagttagaaagtcctagaattgaatctgaataaaaccttacacactctttgcatacttgggcaaaattcttaagttccctaatcagtttcctctttgataaaataaggagaataatacttatgttgcagagctattgtaaaaagagtaaaataataatgtatctaaagcatacagaattatacctgatgcattccaagtgttttataaataattgctattataattatcatgattactgtatagtggatacatgtagaattaattatttaatgtgatgctgaggaccaggccttgactattgagtctttttaaaggcattgtctcccagtttcccatctgcttcacagctccatccatatgcctttttgaaatacacatccagctcctggtcctttttaaacttcgagaaaaagcatcttatgtcatcaaatgtcaatgtaatattaaaggcatttgtatctctgtttaagatcccacatctgttatcagttaatattttgagagattcttactagcagcagtttctgatccatgccataaaaaatgcttttcataaaattgtgtacaaaacccacttatgttttaaaagcccaatgatagctcactaagtatagtgatttcttcaacatgatgttgtcatctgataggtgtgtagggaagcaaagcacatttgcacttgtcctaagaaataaaaagggtccttctgaagttcatttaactcaacttttctattctcctcagttaaaaggttttgccacttgagagtgaaaaattatgaccatagaaattacattttagtaattactcagatttataaaatcatttttcaaataccaaaggtctagtaaaacattaacattcagggatttcactttcccctttatttctaaaatttgcattttatgttatgccttcagcttttctaatgaggattcaaaacatgttcatcatcaaaccattgatgcatctggatgtctacaactttgtagtttaagtccatcccttatacagtagataactattgaagaaaaccaaaactaatgtaatctttgtgaagaaacagggtttttttcagaaatatgagactagagacccaaagatttcaaaatttctgtgggagtgttgatggccgtggccatttcccactcctgaatactaattttgcatgttcccaaactgcaattctttggagtctcttgagtcatcttttagttggtaatattgttgttgcttcctttgctaagtataatctactaaacaatcttggagttctgattacagaccactgcagtatcttttaagtaactctgggaaacatgaagcctaatgttttggttcgttagtattggttagtattcattagtattggttcgttggtattggttagtattcattagtattggttcgttggtatttggttcagcagtattggttaatatgatttcaagtatggaggagagcaccgcccaacaagaatgctgtgtgtgccacacctcccttaccatttgaactaagtgcaacctttcattgtttctttttgcgagtgggtgggggggggcactgagggtgggagggcaactcctatgtaccagacatggaatcaggtgctggagattcagtgataaaccaggaaagatgaatgaaacccaaaaaccaaactagaaaggttagcaaacagttatcaaccaacattctaaaccccaatggctttaaaggtaagtctagggatgttgtactttatttgccatctcttaaaaaaggaattaaaaaatacaagaagaaagaaactctaatggccagtagccataaaatctatttacatattcttccacctctcaagtctcatgcaaattaatgtgtaattacatttagatggcgcagctgctctgacactctgctcccagcttttatttctgagtttcaaaggtttcataaggaaaccttgaaagaaaaaagtaaatattttgaaaaggagttacaatttgtcagcagtaatccttccctggataggcaaagaaaggcaaatcttggtagatgagagaattgtggcttttgaaaataatagcattacactgaaatttaatctgctagcgttattttttccaagcaaaccctctttgcattcaatttgtcatttattacagtaagaagcaacagggtccaaaagagaattgtttgcagtaagcacagagatattctcaacaaaggtagaatttgatagcatgcacaaaacaacacattacttatccagcattctgagtcaccttttcagcaaagaaccttgtgtatttgatagcaaagggagaagaaatcgtgtttattggaatgttaaaatgcgtgatagggcggacattctattttaaagaaatatgagactggaatattgattctgccacatacgaaggctggaaagtattcataaatgatcaattgcctatagtttaatgacggaagataggcattggtttcccaaacctttttatgctacaacaaaaccgcacaccaagccctgccggagggtgctgtataatcatcagagccctttctgagtatgtcaggatgatgcgccctagtgctgaaagatggtggttacatgagcaacagaatgctagttagcaaggcaatgaggagctgaggtccacattaaccatggtcggtgcacctaatcatgaatcacagctgtgccacccttggcagatgaacaatctcttacagataagacaaattttatctgggatcagtatagtcttttaaatgatgtatgaaaccaatttaagaaaggctgagttattccaaatagtatggcttttattctttatttgtcagtttcatcattccctccttgctgactattcagatacatgtaaaggagacagccaatggtttggcacatagttggcacacaatgaatggcagagatccttgtttgtgttagtattttgattatttttcttaccacaataacatgacctgaaccatgatcaatctgtctttatgcttccagtagagatcttgattcatagctctccctaatattaatccatttcatattgttttatattatagttaacatgaattgattttgaatcctttcctctagaagtataacttgtttgagacacttacaagcagacattcaattatattcagagggaaaatttataacagttcaggagaggaatttaactgtcatgtattccaccagcaggtaatgtcagcattttcttatagttaaatggcttcatcaagttactctattgctttaattctaggatgccatcaattttagggcacattatcagttgagtctcaattcttttacactcttgaggaaaacactccatttaaggtatggattaattataaatgatatcctggtttagaaacattctaagataaactgcatttttttaaagttgaaattgatagtaatttgtgagcatgacgtaagtgcacaaaatcttacatgctttatggtctttaatgttgacttaaaactataatatcaaaagagaaaaattaacagagcctaattactctcaatttataaaggacaggtttcattttcaatcactctccagttttctcaggtttcttattcagccgtataatgtcaggcaggatactaaccagattaggctttatcctcatatctttgaaaacataagttccataacaaaattttccctagaggttacttccagtattacagcatctaagtgattcattataagcactgaaaagggtcacatgtattactttattcatttaaatgaaaagaaataaaaaaattctttatttaaaaagaaaaataatggcaggccttggccactcatgcctgtaatcccagcactttgggaggctgaggctggaggactgcttgaacccaggggtttgagaccaacttgggtaacataacaagacccacacaccaccccccagccctgccgccccgtctctactactactactactactactactactactactactaataataataataattagttgggtgtggtggcacatgcctgtcgttccagctactcaggaggctgaggcaggaggacagcttgagacaggaggatgaggatgttgtgagcagtgattgcaccactgcactccagcctgggagacagagcaagaccctggctaaaaaaaaaaaaaagtctggttgtttgttttagaagagtaataatgaagactcataaatgatcacagcctaggaggccctacaaaatggctgcaattattctgctgatgttggacaagctattttttaggatcaattagttaattgtgtgttgctttaattacttacactctttttaaagctttctttgtgtcacagctgagctcaggagaaaaagtaaagcttgcagagcaattctttaagtgtggatgtaaaatatactaatggatttacttgctagctggcacagtgtttaaatagggtcctgctcacgctgagaaaaaatattttatcagcacctgactccaaagagtcaagaatatggagaaactcacatttctctcatgatgggtaatttctgggtatgcaaagctccctgtagcagtcattcagtatggatcacttattgcaattttaaattttttttttttttttttttgagacggagtctcactcttggccaggctggagtgcagtggcgcaatctgggctcactgcaagctccgcctcctgggttcacgccattctcctgcctcagcctcccgagtagccgggactacaggcgccagccaccacgcccggctaattttttgtatttttagtagagacggggtttcaccatgttagccaggatggtctcgatctcctgacctcgtgatccacccacctcggcctcccaaagtgctgggattacaggcgtgagccacagcgcctggcctaaaatttatttttaaactacaagaagggaatggcaaagtattacatgtttcttaacatgcatctagtcaattagcaaagcaagtcaatcgtttaagcttttcattgtgtaaagggggaggttttatacacggcaatttgaatggctatgcctagaacacgtggaagcacagagaaatttcaaagattatgaacaatagaatggcactaaagacacttttacaaatgttgctttatcaagtgggttttgttttcttgtttttcaagaaaaacagtcttccttactttaaatgtttttttcccataattctgtttactattgataagaatttaatttaagcaccaatgggcaattatggttttctcctcaattgattatccaaaatgttcaatgaaaaatgtttgcctgtgggtcctctcacatttttgtttataacctatgactcctgccacttccatacaccctactagtctctgcataaaaatgaggtttattgacgattggccatcacttaatacaggtacttgatgaatgtgtgaaaaataatggatgaaagaataaataaatgagtaaaggaatcaacctctatcttaactcagccacaagtaataaacaatctcgggtcctaatggtctcagtaaaaatctatataaggtctcctaacttcgaattattttcttaaattattatttgtccataggtgtggtcataccttgtggccatgttcctgagacagggtaatcggaatataagtggaagtggcatagtctttttccaaatctagctcatgagaccatcccacactacccccatgcgctttgccttcccttctctgcagcttgattatcaatgcacaaactggcattggagctcatgcattaaagatggtggaacatcagtcagcccaggttcctgaatgatagcatgacacagcgaaccctgctgcaattttggcctacagaaacaaggaataaacagctgtcatgttaaggcactgttatttcaaggtttatttgttagagcagccatttttttcttttaacacacgtcctctgctttcactaagttcccactcaccaaagggttttactcctactattctaatgatgtcctgtgaatcctgacccatgggttagatctcagctcaagtgtggcttctcaaagggaaacttctcttcctccttaatgaagtcatttctcctctatattctcctgggaatcacatgaccctactccttagcacttgtccaggaaatcttcattgccgcaaatgttctctccctcaaggtcattgatgaggtacagatgccagtcacttcaggagctgtgggcatcacccaggaggccagggcagcaatgcaggtgagcacttatgaaatgccccttaggacacccacagataactgaaggagatgactgccaatgcaattcaattgggaatatatgtgtactcaaatattaatacagataaagtcttatttatgtcagcaggcttctaaagttttggaaagttcatgtgacctaggtttgccgaataaaagacttagcaacaatatagtcatctattaaggagctaggaaaaattttacaaaatgtctcagcactgatgttcatttgtgagcccaggtagctcagatgcactgtgcattaattttaactgcatgtgtgttttatgccattggatcttcaaaaggctcttattgattggacatgtggtagaaaacagaggcattgataaaaatggaaacattcagtgccattcaagaaatcaaagaaaggaaccaataacaaagttatatttttattttgttatttaattttatttcgcttttttgccttgagggtgatagttattcaccttctacaagaaaattgccttcactttgattccaactagaacgcctggttgcaatggctcattaagaatgttgcaacttctttccgcccaagtagactctcaattctcctctttgctgaaccctgaggctactcatgagggttacatgagtaacccagcaacacccagctggctggcttttactttttgtcgagtaagcatcattcctgcaaggaagcagtcagcgaccagatttgggcaactcaagtttcccggcttctctttttgtttttcatattttgttctcttgatctcttcctgctcatttcttacaacaaaaactttgctctggaggcatggacttcttaaagaattttagagtattttaatgattaaagtagtatacagtattacgaatcttcaattagtgaagcaaaagttatcattagtccacaagctattttagcattctagcttattatcacttaacgatttcaatgtttccttcctgggatggcaataatggcatgtttcattttaatagaacacatgttttctgttcatagtgctgatttaaatttgtccctccttaattaagtcattctatctaatcagctttggcatattttctcatagtaagtatttacccttttgcctttttgatggagtggaaatataccttagtcattcaacttgataggacacaacctctttaacacaaaatgataccaccccaggaagaaccagggatttttatcatttactttacaccatgcagatgcctcatcttagcaagactttcttactttcgaggatatcttcaaatttatctgtgcaagactggcttcatgggtgtgcaacctgtataacacacagagctccgtgcctagaatgttctgacacttggtttgctgttctgatattgccatcaataaattcttaacaatatttgaataaggaaattatattttcactttaccctaggccctttctgtactcaaatacctatgcaaggcaaagatgtagattcaaatttcatataatgctcattgttcagggaaaataggtgtagtcttgtctctttattcaatttaacattgaggtagaaaatacagcacataaaacttaagtgtacactctgatgcatttgtacatgcacacacacacagttgtaaccaccaatcattttaagatacagacattatcagctgatcatctgtctccctcatccttcttcccactcaatctctgcaccttctatgggtaaatattatgctgatatatcaccaaattttgaacttaatgtaaacggaatcgtaaacaatatagctttttgtgcttttttggcattctatttgtgagatttatccaagatctaacagagatgtatttttttaaagccgtataatattcaattatatgaatatatcacaatttatccattctattgcagtgggtgtctgggttgtttctaatatttggttattgtgaatattaactattgcgaacattcttgcacatatcttttgatagatatatgcactattttcttttgggtatataactaggagtggaattgctagctcagagtatgtacttatgtttaactttagtagacatcagtagtgacctttgaatgcatattataactttttgccaagctgtatccatgccttcatcatgtaagatttattttgtcttcaatacagcacgttggattgcttccaatagctcttttaaacgtcacaaccatttgggatagaacttttctctatttttacagatttttttcaatattgaaatttagaggacttacaaccagaccaagatttcagagtctgaaagaatacattgattctagttctgttactagtttagtttccataaatacagcaaatcagctgtatttattgcaaatatatattaatcagtagtcacagaaagaaagagaaagtttcagcagagctccaatccaaattcctggtacatattaaatgcttaattaatgcttgattctgtgaatatgtattaaactgtgactatcctaccgttagaaacaataagaaaaatactcataataaataatctatgtttttctgagcattttaagttattatttacagttctaggaatagcttaactttggactcagttagaactatcatcccaagggcacaagtatgcttgagtttcagtaataagtcaataaaacctaaatatattgccaaaatcttagaatgagaaatcacttatttaacaacttcatttgaggggcaacaatattcttgagacacattttaaaaagaagtgttaacaaggatatatgggcttctgtagagaccactctagccaaatacacatacgctatacatatgagtaattttcagaaaattcaggtaaggacctgaaatccaaattactgcatgttgcagacacttgtcattccaagagtaaaaatgtacaataacattattctcgcttctaacaattagtccaggaggacatgttttctaaactctccatggagccctccttcaaataattaacactgttagaaaaaaattttacccctgagagttttaacctctagagccactgctagcattagtgctccctctgtttacaattgataatgagaacagagagacataatttaattgggagggtaaaggggaatttggaaaatgatcagggtgatatgcaaatgttcgtttatttggggtgaccattgagtgctgtgtcactgtgttagacatgatgtttagtactttatagactttttgtcttctcccatttattcctcacagcacatttatgagacaggcactgtattgtgccccagaggaaggcagtctcctgtatgcaagtctttagacctcttgcttatctgtaaaagtaggccttgggtctggaacacttccttaccaagagatagagtcctcatgacctgcgctggacttaccaccttgtgtggaataactttccctgttttgttctgctggagcctgtgcatcatgtggcacctggtcaaccccactgttatatctatcctcttccaggaggggatgaggtgcttcttctgcagcacagaaagggcacctataggccaattgttctgcatcagcctccaggagggaccttctggctttgggggactgacatgcagtactgacactgacctggcgctgtcctttctctatctgaggagtaaagtactgacactgatctggcgctgtcctttctctgtgtgaggagtaaagtactgacactgatctggcgctgtcctttctctatgtgaggagtaaagtactgacactgatctggtgctgtcctttctctttgtgaggagtaaaaaacatcgttcctttgggtatatacccagtaatgggatggctgggtcaaatggtatttcaagttcgagatccttgaggaatcgccacactaacttccacaatggatgaactaatttacagtgctaccgacagtgtaaaagtgttcctatttctccacatcctctccagcatctgttgtttcctgactttttaatgatcgccattctaactagtgtgagatggtatctcattgtggttttgatttgcatttctctgatggccagtgatgatgagcattttttcatgtgtctgttggctgcataaatgtcttgagaactatctgttcatatccttcccccactttttgatggggttgtttgattttttcttgtaaatttgtttaagttctttgtagattctggatattagccctttgtcagatcagtagattgtgaaaattttctcccattctataggttgcctgttcattctgatggtagtttcttttgctgtgcagaagctctttagtttaattagatcccatttgtcaattttggcttttgttgccattgcttttggtgttttagtcatgaagtccttgctaatgcctatgtcttgaatggtattgcctaggttttcttctagagtttttatggttttaagtctaatataaatcatgctgctataaagatacatgcacacatatgtttattgcagcactactcacaatagcaaagacttggaaccaacccaaatgtccatcaatgatagactggattaagaaaatgtggcatatatacaccatggaatactatgcagccataaaaaaggaggagttcatgtcctttgcagggacatggatgaagctggaaaccatcattctcagcaaactattgcaagaacaaaaaaccaaacactgcatgctctcactcataggtgggaattgaacaatgagaacacctggacacaggaaggggaacatcacacactggggcctgttgtggggtgggggaagcggggagggatagcattaggagatatacctaatgtaaatgacaagttaatgggtgcagcacaccaacacggcacatgtatacatatgtaacaaacctgcacattgtgcacatgtaccctagaatttaaagtattaaaaaaaagacacctgcatgcatatttttatcacaacacgattcacaattgcaaagataaggaatcaactgatgagtggataaagaaaatgtgatgtgtgtgtgtgtgtgtgtatatatatacatacatatatgtgtgtatatatatatacatacatatatgtgtgtatatatatatacatacatatatgtgtgtatatatatatatacatacatatatgtgtgtatatatatacattacatacatctaccatgggatactacacagccataaaaaagaataaaataatgtcttttgcaacaacttggatggaactggagtctataatcctaagtgaaataactcaggaatggaaaaccaatattgcatgttctcactaagtgggagctaaactatgggtatgaaaaggcatacagagtggtataatggaaatgggagactcaaagaagagagggagggtgagggtggttaaggaaagaaaaattatctattgggtacgaggtaggctactctggtgatgcgtacattaaaatttcagacttcaccacaatacaattcatgcatgtaacaaaaaaccacttgtacccctaaagctactgaaataaaaaaaataaaaatttttttttttaaaaaaagcatcgttccatccagtgcctgattgtgttgtgttttccttggtgactccaatattaaaatcaaataggcagaaatgctgatttctacttctgatataggcaagagatgccacttcctccacagtccctactttgcaaaagaagaaactgagtcaaagagtacttaagtgacttgtccaaggtcacccagtgaataagaggttgagattcaataggccagacctattttattcaaaaaaatgggctttaatccacacttttctccctataagcttttcttatgtaacttaccattccaataaagaaggaatgtggaggattcagatgagattgcagatgcctatgtatcaatgagcttcatgaagctttctgttttagcagtatctgttatagcccaatatgctttaaactgaggcactagtgtggcataaagctaactcaaatctatttattgctacaatcaagaggttgacatgctttgagaacattcaagttaaaagaacaggaggtgaaatataatgaaagagaaggatacagaaagaaaggactgaaaatatgattaaatgtcagagaagaattcagaagtggtgttgtagaactcctaagtgctcacacattttcattaatcataccattgcaggatactatgaattgtgatcatctactgcccatttatttttattttgtttttgagatggactctcgctctctgttgctcaggctggagtgcagtggcatgatctcggctcactgcaagctccgcctcccaggttcacgccattctcctgcctcagcctcccaagtagctgggactacagttgcccgccaccatgcctggctaattttttgtgtttttagtagagacagggtttcaccatgttagccaggaaggtttcgacctcctgacctcataatccactcaccttggcctcccaaaatgctgggattataggcgtgagccaccacacccggcccatcacaggtattttctaagttgtaagatctatttcctcattatccttcacacaataaataactacctttataaaatacctaatgtgtgtgaagtatccttgtacatgctattcataactatatcccatcacccatcataattttataaggtaggtaaaactttaaacttcattttagaaacatgatttggagaaaagagaatgcttatgcactattggtgggaatgtgaattagttcagcccctgtggagagcagttggagatttctcaaagaacgaagagttgaattaccatttgacccaacagtcccattactggatatatacccaaaggaaaacaaataattctatcaaaaagacacatgcaccccaatgtccatcacagctgtctgtaatgttggactggataaagaaaatgtgggatgtatacaccatggaatactatgcagccatacaaaagagcaaaatcttgtcctttgcagcaacatggatgcagctggaggctattattctaagtgaactaatgcagaaacagaaaaccaaatatcacgtgttctcacctattagtggaagctggacactgggtacacttggacataaagatggaaacaataggcactgaggaatacaagaggagagaggcatggagcaggacgggagttgaaaagctacctcttgggtacaatgctcacttcttgggtaacaggttcaatggtactccaaacctcatcaccatgcaatatacctttgtaacaaacttgcacatctacccccagaatccaaaataaaagtagaaaaagaaggaaaagatacctgattctttttaagcaatgtggacaaggccccagagcagtgacagtccagggtctggtgctcagatccgtctcagtctaacgattaaccatgttctttccacttgtttatatggcttctatcttattcctctatgctcaatggatctctatacctctagttataaatcccataatgggcagggtaggtatcctgctggctgtgtcactcaatagaaaacaaagagacagaatctacaagggctactaggcccacgcctcacatttgttggccacaataggaatatatacagaggctcttggcccacagcctgctctcctccattgtcacctctagctcagtcctgcactgtaaagatccttgcatacatatctatgcccaccccaggccacaagtccaagctcagttcacatcctccacaaataacgaatacttggctactctcctgagctgtaaccgtgcacacttttgtgcaattcaccattcagagttggactcaggaaaatgactcatgcaggttctgaaaaattggcttgtgccacccacttgcataacagattctgggatcccaagtacctgcaatgtggaatagaaggctgtgtgtgggctctggacaggcaggtctcaccttggccctgtggggaactgcacagcaggaagagactcagagtgaaccgctcaaagtcacagtgcccatggatcttcaagaggtgtgtattgactggatgattggcagaaaaaaggggcattgcaacaaatgagatcattacaggaatcaaagagcccaaatcatagtttttaaaagatttttccttggagttgctaattattcgtaatctacaaggcaacctcagcttattctactttgattccaactgagaacagccaggttgcaatgcctcattaagaatgttgtgatttcttttctgactgggtagacacacatctctagcttgctgaacctgcatgttaccactagagctctgcctctgaaaggcaaggaattgccctgttcttgcccctgctggctctcactctgtggggagcaggcactgcttctgcagggatgcaaggcaagtaatcacacatccttctaagaaccttatatcagatactatgcccatgatgcaacttcctatctatgtcttatgaatgtcttaaagaattttcataaacttgaatgatacaagtgatatgaggttagagggaagtcagaggtggtggactcacttacatttgctgattaaatacatctcagttttctgttttggtaataaaaattatctaaagttcaactcccgggaagggctgcttctctttttccccttctccgtcccagaatggctccaggtacaggaaaacacctactagtgttgtagatgaaatgagaatgaaacttgcattatgctcatcgctgggttggtttccattgcaaggcatggttgttctaatcctggaatgtgccccagtcggtacttgatgagggctagtgggcaggaatcccttttggctgctgcctctactcactttgaatatacttctattttgtatttcctccactcttcctatttttttttaagagttctctctctttaatgcatgtgcttagttcagtccaatgaaaggggaaaggattgaatctgatgacctgggttcactcctagctttactatttcccagctatagaatattgggagtccctggacttccttgagacttagtttgtttctctgaaatataagggcataatgtttgtcctttatacagcatagatttaaagatcaaaaagctgtagtttttttgtaggtcaaaggggctctgtaaatcgtaaagtgcttgcagaatggtgaagtggaaatacggtgggattaacgtttagatgacccagccttaaatccaggctctgccaatgattggttttagattcctaatatttagaatgactagataactttgactttccttagaggtctaataatccatgaaattaaaatttcaagtattcaaaaataatttaaattcaacctctgagtcaggaaatgaaaactgatctctttagatttcaaggttttaaatatgataaagtatacataagcagaaggaaacattggaaatagatgtttcacttgaaatgggcagcttttttagaaagggaaacatacaggatccctcctcatttaattcatgtgttcaacaaacatttactgagcatctactagtaaggatgtagaaatgttcccgatatagttgggagatataaaaattagtatgtttgggagcctttatatcaagggatttaccattcattaatggagagaagctcaagaataactacaataagtgggactttcaaaattgctaccaatgagagttatttttaaaagttccactgggaggtaagaaaagaaggaatatatttgctctgtggcagacttaactgtgaatttctggaagtttcaacgaaaagctggttcatcaagaatgcacggaggaataagaatatgactgtggagtaaatactgggtcgaacctcattgttctacaattttctgagtgtaattccacaaatgtcctatatttcttagcaaacatccatttaattcttttctgagagcacgttctaagtttgggcatgaatatgtctgtgttgacgtgtatatatatgactttgcctgcatctttatatcttttttcctcttttacaaaaattaatatagaaagttctgtcatgatcccaaggtataacatgacagacgcttcaggaggtgtctggtctagttggtgagataaaagccaagatgataattctttggtgtatgccaaatgccatgcatacatgatcccatttatctttcacaactgtgtaagccaggcactgtgactagacccgttctccagatgaggagcctaagtcttagaaaggctgaataacttctactaagaatgtagcttgtatgtgttgggtttacgcctcaggactatatttaacaaatacttaaaacttaccacgtgctttacaaatactaactcctttgttatatctctctaactagtctatgagtagatgcagtcttatctccattttatagttgaagaaattaaggaacagagactcagcaacttgcctgaggtcacacggttaataagtggtacacagctggtgtttgaagccaggcggtctgtctcccagtccatgctcctaaccactctgagggcagcttctcaaatcccgctagattgggcttcaaagccctatggttaatcactgtacaaatggcctctttgtgctatcacctgaacagaaacaaatataacatccgtgacatcgagagagctgctaatccaaccatctgcattcaggttctgcctctgtgctcagccagcctgcctctgtaaggcactaacacacattctttctaccactgacctgcactttggcattctcatcctgtggctttaattaaatgttaacattcatttgcccttttccattgtgttaaagataacctttgcttcctgtcgcgtctagataagcttcactccatgacaggtaccaaataggttcatcttgatataaagtaaagaatggagactctttgatcctctctgctgacatattttaaaatgccagtatgaatatttgttttgtacttacttcttttacggaatgtcaggataataaattatttctggatactgcagtagctgaaaggttcaagtccaaattagtcatactaagtggctttgacccttcctgagagtcaaacagacttatctctgagacacttttgtttctaatagttgaaaatacattatggagagaggtgctggttgggatttagagggtcacaatttgctggtttggaggaaggttataaagaggttttctggatctttactcatacattcactctattggatgggggatggcttcttgctaaagtgagaagagcattagactgagaatcaggcctagattccagcctcatttttgccacagatgcattatgtgagcttgaacaagtctcttattttctctgaaccccagttgctttattgttttaacaattatatttcattaacagtacataattgaaggatgttatctgatttgctcatcagaataaactcatgagatgcagatttgtattcacattttacagaaaagaaaactgatctttagagaagttaagcaatattcccaaggtcataacacagctagtaaaggaggtggagccagaattcaatcgtggggctatccaatttggaaatccatgctcttcaccattatagctacattcattgttggagagttctacatgtttatgagtgtactcattgtcgctttagagatgctgcatgtatctcctaaaaatgtttttggcagatgatcactgtctttgatagcccattgcagtgatgccatctctaatagcatttactttcctagcctcggaaaattagacacccccctggttagtcagggtggttattggcagcatatataaaattatcttgaattttacagaaagaagagaattctctgtgtttctgaattttggtactaggagaaatattatatttttataagttataatgtattagaaaaaggatattttaaaatgtaagagaaaacaagagttaaagatgagcttggaaaaggagaaatggcagaagagattcctctttggaatgcatcttacaacaactaaatatacacagagtatctatgacaataaaacacttcaaaatattagtaatattttatgtaggtgatgggattatagaatttctcatttcttttttctttttaagctttgctaaattttctgtaatacatatgcattgtttttgtgctaaaaataagtgaaacacacacttatgtacatgtctgcagcaagcaaacaataaaccatctagtagtcttaggctagctaacatcccagacagcaatttgtctatggcacatatctagactaggctaactgcccaggttggtcacatcaaaaaacatatgtccctttgttaatctctctgatgtcatccattatttccaacctaatttcatattagattattagtgcaaggctttcctaaagcaatacacctcttaaatgattacatgacaggaagtcttcagactaagagcctattttaatcagttatttccacttctaaaaattatatttactttctttttcattttcttttttttttctccttttttctttttctttttttttttttttctgagacatagtctggctctattgcccaggctggagtgcactggcatgagctcagctcactgcaacctccacctctgggactcaagccatcctcccatctcagcctcccaaatagctgggactataggtgtacgccaccaggcccacataatttttgtattttttgtagatacggggttgtgccatgttacccaggctggtctcggactcatgagctcaagtgacctgcctgcctcagcctcccaattacagggattacaggtgtgcgccactgcacctggcctatatttactttctagtcattgaaatagatcaagttttttcaatgcaattaatgaaatgcattatcctttatttatgctaattttgtcctccattccatatgtctagaccccttgtactaatttttggctatcccacagtttcgtaattggccttactctttctcatgattcaccagccataggcacaatgtcactagactactctttctaagatacatcaagtgggtcaatgcagtctttgagaatgtatggtatttgccccaatacctataatcccctccaaaatagcagacaaaatagtctcttcataacctggtcctctaagtttggtatcaaatcacatttccttgatcttctaacatgcttcaaccacacctgcctttctgccacatggtcatactttactcagcccctggccttctgctttgattcttatttttttctggtcattgacggtctttttttccccttctgcttattttctttctagtgttatctcttcctaaagccttctgcaattaccgtgcctattgaaattgctctttttcatcagtctttagtaattaaactcttttgtattagtccattttcatactgctgtaaagaactgcccaagattaggtaatttataaaggaaagagatttaatggactcatagttcagcatggctcaggaggcgtcaggaaacttacaatcatggcagaaagcaaaggggtagcaagacaccttcttcacaaggcagcaggaaggagaagagcaagcaggggaaatgccagacacttataaaaccatcagatctcataagaactcactctctataaagagaacagcatgggggaaaccatccccatgttccaattacttccacctggtcccatccttgacactcagggattataaggattatggagattacaattcaagatgagattttgggtgggaacacaacaaaaccatatcatctttactaaatatttattgttgttttttaactaacacataataatttacatatttatagggtacatagtgatgtttctatacacaccatgtatagtgatcagatcagggtaattaacatatccgtcatcttaaaacatttatcattcttttgtgttgggaacactcagtatccttctaactatttgaaactaatatatcattaactatagtcatcctatagtgctataaaacactagaacttattcctcctatctagctgtaattttgtatcctttagcaaatttccccctacccctctttccccaacactcttcccagtctttacaatcctttgttctactttttattctgtgagattaacttattttagcttccatatatgaatgagaactttctgttcctggtttatttcacttaatatgatgcccttcagttccatattgatattctgtcatttagtaagatttcttttattattctctaggtcatatctctatctatctatctatctatttatctatttatctatctatctatcatatctgtatgctgtggctccccaatatggctgttagttgtagaaaggtaggagtgtaatctgtatattgtattttctttttatccctatcagtgtcttgtacagtgttgagaatatagtaggtacttgataaaattttgctaaatcatatttaggttcgtgataactgagtttaatcctccaccaaataaatgagatttcgtcattagtaaatcaaattttaagtacaaagatcatttaatttttaaaaagttcaataattattcacttattttatctgtttttgactataaacagagcattgttcatgctcaaatgcttaactggttgaaagaagctcttcctctgacaacttcctgtcaaacggttatttaaaactctcaagtgtgttgctctaggagaatgacaccacggtgatttaacatgggatgatgcctaaacaatggatgacagaagagttattaacaggaagcaactatattgcagtgtcctcaaagactcctaaataacaggaaagttatcttcactcaactagctgcctggtaaagactgttgcctcattaacaattgttgcctcttttattttactgcctttatttttcttttactatactttgctgctgtggttattaaactgccaaagccagtatggaaggaggagctgtgttttggaacccagtgttctcatctgcattctccctcagcgagattttctgtcatcaaattagcctagagaaatagcatgctgattaaaaataagctttaagttccattgaaagctagaagtctattatttgcctagatccaggcatagaaaggaagacactcaatataaaagaattaccagttacattctgatttccattgtccttttaaagttaaattatttaaaaaatcttatagcagaaaaatggcttgaagtaggttttatctaataacttaggtggataaacaaaaaaaatcaatttgatcattattgcccaatattgcgtcttatgtgcagaactttatattactataaaaatttattttagtattccttccaagtatccactgaaagagctatatgttttccctccttccaccttcagcccatgaagacagatcctattttctcaaataatttcttaatgtttaatgaataattaaactgaatttcaaatatgtaaagagctaaagagatctcatgagagttatggacagaaaccaccatatgtaaaatgcaaaaaaagattaaaatttatcaatggagaatgatcaacactgaaactgatgatgcccacttatatattttttagaatttttagaaattaattgaattttatacttgaaaaataaggatttgtaagcaatattaagcaatagtgaagtttagctctaggtttagaatcagagaaactgaatttgacttctagtgacataatctcttaccaggtgataggttggtcatgtgatatctttttctgattcttaataatgaggataatgtcattcttacttttttcaccaggtgatctttcagaataagactgtgaaagtagtttgtactcataaggtgctctagaaatgtaagttattatttctcccatatctattgctatataaactgtgcactttaaagttttatctatatggaataattctaccctatgagaggggctcccaacccccgggccacagacctgtaccagtgtgtgtcctgttaggaactgggatgcacagcaagaggtgagtgagcattactgcctgagctctaccttctgttggatcagctgtggcattagagtctcataaaagtgcggacccgattgtgagctgcgtatgtgagggatccaggttgcatgctccttatgagaatgcctgatgattgatgatctctgaagtggaacagtttcattccaaaaccatccctccactgtcgcctaggtggaaaaattgtcttccaggaaaccgattggtccctgctgccaaaaagattgggaactgctgccctatgacatctaagaaagcaaagctgtttagaaagaaaacatagtagtttatgctgggcactagctatatgctaggcattgtgcaagcagtatttaacttcatcttcaaaataaccctctgagttagggacacaattatatccggtttacaggtgaagaaatataagcccaaagaggttaaaaacttgcccaaatcagggcataaatagtagagtcagctgcatcctagattttctccaaatgctgtccccttccccaccatattgcattggagatcttttctttcatcacaggatttataaaagcaaaagtccacttcagggaggagccaacccccttgataaagacatgagggggacttgcccatcaacaaagaaggtgccagatgcttccctctcagatggccctggcagcatgcctgttccataaattgcctcagtgaggcttctgctactacatccctttattaaggcctttctgtgattactctgctgctttctttccaatctctcagataaaagagcaaataagcagatgaaaaatgcagtctaaaggctgagttagaaagaaactgcactatgagaagcagggaaagtaactaatattttctaagtcactgtcatgtctctgcttctaagttgtcttaatccattcacaacaatttcctagagctgtattattattaccacttttcacagaatacatttgcactcaaaaagattaggtaatttctcttggaacctggtttgattcaaattgtttccaaagtctccctttgtgttattacaatagaatgcaaaacaaggaatgaagtacagtgtaagttattcattatcaagagggcttcgtcagtcccaaaagggtaaaacattgtttcacggttgtcttcatctgtttggattgctacaatgaatatcacaaactgggtagcttctaaacaacaggaatatatttctcagagtactacaagctaggaagtccaagatgaaggcactggcagatatggcatctggtgagggcccatttcctcaccagacaccttcttgccatatcctcacctagtcgaagggctgagggtctctttaaggaggactgttttataaagtcactaatcccattcatgaggactccaccctcatgacctgatcatctcccaaagtctcgactcttaataccattacagtgggttaggatttcaaaatatacattttggggaaacacattcagaccactgcaatatctaaaaatctttctcttgctatgtgtaaggcatagatatgcatatagcacataaacaaatatacagtatacatggggtattaaaatttcattggagaggtgattaggagaaaacatttgaaaaagctttttaggaggacaaggatgaaaaaaggctaagaaacacaggtgtaaagaaagaaataataactaaagtgaactaaacttgcagggattttggctctcatcaaggtccggacgaggtgcatgctgtttctccactgcgtcagccatgggagatatcatcgtatattttagagcacatgaggcaaagttgggggcacttctcaaaacctggtgaaattccatcgaatccaatcaaagtccagaagaatcagcactatttttctttctttctttcattctttctttatttttattttattgattgattgattgatttttttgagatgggatcttgctctgtcacccagcctggagtgcagtggtgtgatcttggctcactgcaacctctgcctgccaggttcaagcaattctcctgcctcagccttccaagtagctgggattacagacgcacaccaccatgcccagctaatttttgtatttttagtagaaatggggtttcaccaagttggccaggctggtctcgaactcttgacctcaggtgatccacctgccttgccctcccaaagtgctgtgattacaggcgtgagccaccatgcacggccgaaagcactacttctaaactgttaaactcctagaatcaagcaatcctccagcctcagcctcccaaagctttgggattacaggcataaaccaccatacccagcccaagttattttcagttaaagaaacacagagaaatggtttggcccatgtatgggcaaaccaagtctttgctgtgctcctctctccacacacaacgttctaccatcacatcacaacctgcctttcattctttcatccgtctcccaggatggagtcagcccctagattcatgcctcaaaaaatccttgatttctccacctcacattcttcttttgcctcttggaatgtcccatgtctgcacagagtgtcgtacagcccagacactgcatttacaaagacctggatttgaattctgactctgcaatgaatgactgggtgcaattgatatatcctcttcttatgcctcagtttttccttatgtaaaatgggactactgatttttaccttatgagacagtcatgaagagagaacatggaagccatttagcactgtgtctggtcagtagtaagtatttatttgatgttaatataccaggaattttgacaactaagttattctcttcttagatctgaaacaatgtgtatgtgtattacatatcaaacaataaacatgtgtgagccatgaaaaatcataactcagatgacatctccttcaggaaatccacatccatatccctgtctcctctcatctacctctgagctggtatacctttcttttgttgtgttctttaaactgtgttataaatggtccgtttacgttctgtctctttcattaggctgacttccccgtcaaaaaaaattctgccttatgaaatttcctatttttactacctaaaataaaggtttttcataacttactgttaaatgatgaatgttggtgatatgtttccactagtttgattacctgtgttgcatggatgtagcatatattttcatctttgtcagaaagaattttatccctgtatcttaaagctgggacaaaaggccttaccattgaatacaatcttacttctgttgatttaaaacttgactatatatgttaaacctcttaatatagagagaggtatatatgaaatttatcttaaaccataaaaacctacacagtttatacttctttcttatttcaggatgttttctcatttattatcagtctgtttcatataccatgcataattccagggagagacatgcaggaggtaatttctttctatcctttcttgggcttcacagctaattttagcaaatgcatttggcaaactttttgtagaggttcatagtatttattttgcaatttttcattatgagtttcaagagcacaaaacccaaatatcagggagaagaatgcatactgatatcagacatgcagtgttcactagtagcccttatctactgaatcgtaacagcacttaatcttataggtacatattgacagccaatttatctaattactcacattcacaaattaattggagtgataacaggatatattatcctcactctgacatgtttttggaggtcttcagggagacttatttcttgaaacaactgaactcttgaagtcgtttaaaaggatctgatttataatcatggcttagaacgtatcttcattcccttgctgtcctttttttttcaattaatgaagatacttcaattagaaagtcatacagctttgttggaatgacaatgtgaaccttttcatggttaagctcaatagccaatgttacaatctacacttctttgagatttaactaaaagacatattcattgattcaagcaaatgcgtgttcttttcctagtaacactttcttctttatcctttgaaactccatgcaaatgcaaacatcactttctcagaagcctttctggactccttccatatgtgatgaggttggaagcttcttctctgtgttcacctggaactctgtgcatgctgggcacattataccatttcactgtgatcttttatctcttctgttgttaagcaacagatcaaggactgttgcctggcacatcttacaggataggtactaggtcagggaaaagggataaaaatcagaaaaaaggggacctttccttgaggaatcacattttactaggaaatacataaaagtaaactagcaattaaaattaaaggttaaagtctatgaccaagatattctttgttgttgttgttgtttgtttgtttgtttgttttgagacagggtcttgctttgtcccccaggctggagtgtagtggatcctccatggcctactgcagcctcaacctcctagcccaagccatcctcctacttcagcctcccaagtagctgggaccacaggcatgtgccttttttagagatggggtcttgctatgttttccaggctggtcttgaactccaggaatcaagcaatcctccagcctcagcctcccaaagtgttgggattacaggcatgagccaccacgcccagcccaagatattttcacagttcaatgaatgcaaagggcggttgagaaatgactttgcgttggtgcgggtttttacaaggatcaggttttttgggctattagtttgtttgctatgagagataactccatggatatttctgatgtgctattattaaattacacatttaaaaagatagcttaatagcaagcacctgagcagctaatacttttatattctaatgtgtcctcactgtgtacatggccatttgctttcactatatgtaatttttaaaacgtagtttaattcaatatttcctaaacactaactataagtgtgttaattgctgtgaatgacatgaggctgagtaaatttgtcatcttgggaacttattttgagctggaccctgtctacataataggtactatactagtatttgtcctaggccagattatttaattcttgtgaagacacggggaggaagatattatcatttctatttcagagattagaaaattgataatcagaatagttaggtaacttgttcaatgtcacacagctgagaagggggtagaacgagaactaggatcctttcacccaagcctggcttcttgttaaactagtatatggtttcccagaggagtcaccatgctatctagtggtggaagataagacatgaacccaagtggccctgttataagaagactgtcctaaaccctgaataaaccaagaacattgacatttaagatagaaaaatccataaaggcttcatgaagaaggcttcatgcaagaaagtgggaaagatttcccaaagacacggtaaaagggagataggaacatctaacataatctatagtatctatacttctgacaagtttcatactgaaaaataagtaataattactgtactctgaatacctattgtgatttcaattataatcaatattcactgaatgactactatgcatctggtagtgaatgaagctgcattatcttatctacttttcattacgagctacgaagtagatgttattgtatctcattcaatatatgaggaaactgaggtaaaggatttaagtaacttgcccaagcctcacagtaaaataaactgcagagctagcattcaaaacactgtattacttgacctactgttaatatttacgaagtgcttatctctgtgtcagtcccataataagggctcaataataagagttgctaccatttattgcacattattacaaaaggcatgaaagcaagactatgtacaacaatctcaaagaagtctacatggtcgtttttgatgagggattggtgttgggaggagacatgtgggcaaaggcaagttgggagcacaaaagaagaattttcaaggtcagaaagcatttgaccttgatttgagaaacgactatcaaacaacaatggtgttacagcaggccagtaacctgtagaacccaacttataaagtgcgcatttaaaatgcacatttgaaagtgagagatgattgacctagacttggaaagtgattgaacatgagctgcaagggggaaggaagattaaaagatgagttttggggaattgagcttaggtagatgagtgggatatggtggtagattaaattaaatacaaggcaaagagcaataaaatcagccttgggttggggctgggtcaaaggcatggaaggaattaacagaaggaaaatgacaaccctgtttggagaaactttgatttataggagccaatgtggtgtacatctaatgatgttcagcaggttgttaaaaatatgtgtgacttagtatagcccatgagagaaaaggacagggttaattatatagattttgaaatgatacagaactgtgcaatattgctcactaaattattactcattgtgtccaaagtagcttttggtcaccatccccctgtatagtttttttttttaaatttatttatttatttattattattatttttttagacggagtttccctgttgttgcccaggctggagtgcaatggtaggatctcggctacccacaacctccgcctcctgggttcaagtgattctcctgcctcagtctcccgagtagctggaattacaggcacccgccaccatgcctggctaattttgtatttttagtagagacagagtttcaccatgttggccaggttggtctcgaactcctgacctcaggtgacccacccgcctcggccttccaaagtgctgggattacagacatgagccactgcacccagcctgtatagttttatttatttatatttggtgtgctttccagtacctgaaattatgtacaccatatacatttatctttatttttattatcagtattcttcatttcattattataaggaatttatttgacattttcatcactgtatttatagattctagataaaacttggcatattagagggcattcaatgcatacatttcatatgaatgaatgagtatataaatcaatgggtctcagtttttatatccctaatgtaaaacacacattctttatcactaataggccattgatactcctaagaccatgaggaaatctatgcactatctgctcagaaaaaggcacagacactgcaatttctcatatacgtacaaaggattcacagacatctcaaggcccatagattcatctagaatttgagatgcaaagctatgggctcatccagcatttctctcactgtgaaccttgagggaaacctaaacttagggattttgattgtttttataactgatttccaaatatcttagtaaaagtagtgtgatatatatatgtgggagtattaactctggtttctaccctaaagcatgtgggtgtttgaaatacccaaattgggagttcaaattccagagatggctattgcaaatcttgacaatatttttaggacttctagaaatattataaattcgtaaatttaatcaatttataatattgataaatttaattataaattgataaaattcattggttttaaaaactgtggttggcttaaatgaccacaaaagcaacaaaggttgcttttgtgaacaaaatatgcaacccagcaaacccagcagccctgcgttctggaaacaagctctgtggctggggttctgatgggtccatgtatggaagatctctgaaacttagctgtgtgaaaggtaagctgaccctgctgttagaacatgttctgtccaccacagggataaacccttcctgcaaggtgctcgtcaaaaagcctaaatgacagagattggagaccccactgatgtcacagaaagaatggcttgatatgcacatatttgtttgggtgtgtgtgtttgccaaataatgggtggaattattgggtctgatatttgctttcactgtaacataaagagaagaagatttggttaattatatgaatttttgaatgatccaggtttcatgtcctataaagcccaagagcaaagtaagaggtcaaatagccttcaccattcactaatggttaaagcttacaaatccttgccaattatacattctcaaattaacctacattcatttgcaactggttgagagaagaaaggggacacgattaaattgtaaggagacctcagagaaatgggaggagagatagaaaagcaccacaacattgaaaaaacagcaggaaggtttcaagtgggaaggtgtttggtggagttgacaaatgcttcatactttgaaacatataagcactaaggggaaaactttagttttaaaattagagataaaattgattccttttaagaaaaaaaaatcaatagaatggcagtggagtggaaattttcagaaaaagaaatattaaaaacttactgagttcttcttctgtataaaatactgtgtcaggttttgttaggagaacacaatatataagacagattttctgaattttaacaatatttgaattggggatttcttcaactgcaaaaggagatgttatgaaaaatagtgtccaagaataatgaaacacaaagaagttattaattatttgtttggttgctttttcacttattctgttctaatttatttattttatccagtttattcaatctccttttggtaaagtcgtaccaggttctccctttaggtaggtgcttatactccattttcactatatggctagtacagtgactatgtgactatgtgatacataccaccagctctaaccatgggcacaaattgggttgagacaattgatataatgcttcactgataataattgattaagggatgaacctatggctaaattcagggcaataagaacgaggttcaggaattctattagatacctaaggaatagaagttctcacacaccggggcctgttatggggtcaggagacgggggagggatagcgttaggagatatacctaatgtaaatgatgagttaatgggtgcagcacaccaacatggcacatgtatacatatgtaacaaacctgcacgttgtgcaaatgtaccctaaaacttaaagtataataataaataataataataataataaagaagttctctttttttacagttgataggaggaatttaggttcaaaactaaaccttttttgtgctacttgaggctgagcctagaattcccagaggttctcagtctgaaacacagaatcaaagaagaggggaaacaggaattaggtgacattattttagctgctgaattaagcttcacctgaagcttcacttttagtttctaaaagtttagaaatgtctttaaacttttcagctatgtgagttaatatattctcattgttattgaaaccagtttgatttgaattttttaaacttgacattaaaaaaaagtcctaatggagaaatgtctttcagagattctggaaaagccaaggtagggatgaaagtttatgaaggcaaacaatgggctaaatctagaaaaataggttggaaccagcaataaagagccctccaagcctccaaggtatttaaattagctacagattgggcttttaaataattcatcgttcattcctctgtgctcttaacacctgctccttaggcctccagtggttactgatgttgcccagtcatggattacagctcattgttcaaatgtttcttttatccactagattgaatgaaaactcctccagtttttttgagggcaggggttattttttactcaaactactaacctcacatctcctagcataatgcctgttacatagtaagtagttgtagcagggaggaatgaagtgagaacatgtattaatccgttttcatactgctataaataactgcctgagatggggtaatttataaaaggaaagaggtttaatcgattcacagttcagcatgcctggggaggcctcaggaaacttacaatcatggtggaaggggaaggggaagcaaggcaccttcttcacaaagcagtaggagggacaagtgcctagcaaagaggggagagccccttataaaactatcagatcttgtgagaactcactcactatcatgagaacagcacaggggaaccgcacccatgattcaattacctccacctggtctctcccttgacatgtggagattatagggattgcaattcaagatgatattcgggtggggacacaaagcctaaccatatcagagcatcattttggcaactccactctggcagcagtggattgaaaggctggaatgaaataaaaaggaatgagaagagaaggtatgcatttcagtatttcagagagaatggaaaagggctcagagaaataactcaagaaaatgctacaatctgaatctaggcagccccatgaataaaatggagatggccacacgaataagttttcatacagtgatcctttttcctgttcctgttcttttttattcatgtaaagttctgaaaactgttgcccatggtaacattcagtggaaagctgaccagtatttagacacatctatcagatcaaacgttgatgaaaaagccctgtatctttcttttttctagagtcagttctaaatatagacaggatgggctccttagagcaatagaagtgactaacattgagttgcagtattgacaatgtccttttctcccctaaatacaagcaaatttgaaataaaaaataggataaccccaaagagataagtgttttaagcatgccagatattttccagtttttgttgtattttagagtgttgatctcgcactttctgccatgagagcaggatgttcagtaaaaagaggaattagcaatcaaaggaagcactggtcttaaagaagctttaatgcatttgagtaagagatattactttctagagtaaactttagaaataggtccagtatacattgtcatagctgattgagaaaattttctaaagactcagtcttagaaggcagcacatacctcaccctatttataaaatttctttcaattttataaatgttaaggtaatatcctattacttcagaacacttggaaaatacagagaaaaaaacacaaggtgttttactcatgatgtaatctgttcatgcaactactgttaacatgtttttaaatttttttctttagaatattatttacttaaacacaactaagtaaaattttttacactctgtgtctttgcttagataagtcttccctgactttcaatttgtaattttatcccttccctgtccccactattctttttccctagcatgtttgtttttgctttgtagaacttaacacaatttttaacagtggttgtacattttttatgccagtttttcacataaggacagaatcacagttgtgttttgcaatattgcctacccaacaggaggcaagttgttggcatatagcatgcacagaaggtagacgactaaagttttcaggcattgtggtgcagtggtttaaagcagcaggctctgcagcctggcttcctggatttgaaccctttgagaaaggcagaatactggcctcccaaagatgtccacatcctaattcccagagcctctaaatatgttaccttacataatacaaataactttgtgagtgtgactaagttaactatctcaagatgaggaaatcttcttaggatatctgatgggtccagacaaatcacaggggtccttataagtgggaggcaagtggggcagggtcagaaaaaggtgatataatcctggaagcagagagagagcaagatactggaaggggccatgctgctgactttgaagatagaggataaggccacaagccaaggaatgtaggtgactgctaagaatctggaaaagataaggacaaagattctaccctggagtctccataagaaaccagccctgctagcttattttagacttctgacctccagaactgtaacagaataaatctgtgttgtttaaggcactatgcatgtggtcatttgttccagcagcaataggaaattaatatgcctgctttgcatatgaatcgtctcagcagttcaatcattctctctgtgcatcagtttcctcatctgtaaaatgaagaagaaagtggcacctgcctcacagcatagtttaagtccataaatactgcaaagcatgtagaacagtgcttggtatgtcccatgttatcaataaatattaattgctgttgaaagtatatattatcaaacaaacaaaatgacagtcagttactcctttctaattctttaatttaccaatgcaatctatcggtgttaaatttctcaatctttcttacttagttgatgaatagggtgtgtgtgagtgtgtgtgtgtgtctttcttggtatcacagtttttaatttgactgtttagttcatctgctgggaggaggaagagcccttagtcatctttgttctgtggttcacctttagccgcccactccttgcccacattggaggtcacggttgaccctataccagctcctaaggccacctgcttatcagccgaggaatcttctctagtcaacctcacattctttgcatttgggaggaagaaaaaggtgattgcttttattggcctacatctggattccctctttctctctgccttgcttttcagttacctcatcctcagttttaagaatctgcccagcccttcaagatgatgctttgtgttgtccccgtctccatcagtttgggttgccgtaacaaaaatatcacagaatcggcagtttaaacaatagaaatttatttctcacacttctggggactgggaagcccaaagccaaggtgctggaaaattctgtgtctggtgagggcctgcttcctgtcttgtagacagccatcttcttgcagagaggaagagagagcaatcctgtgtttcttcttttttaaataagggcttcaatcccatcctgagggccccaccctcatgacctaattaaattacctaagccaacttacctccccaaagcctcatctcccaatgccattacattagagactacagtttcaccctatgagtttgggttggacacaaacattccacccataacagtccccttcactctacagatattcccccatggttctacttacaatttttcaactgttttttttttttttttttttttttttcagatggagtcttgctctgtcacccaggctggagtgcaatggtgccatctcagctcactgcagcctccacctcctgggttcaagcaattctcctgcctcagcctcccaagtagctgggattatagatgcgcaccaccatgcctggctaatttttgtatttttagtagagacggggtttcaccatgttggccaggctgctcttgaacttctgacctcaaatgatccaccctccttggcctaccaaagtgctgagattacaggcatgagccaccacacctggccccaatttttcaactttacgatgatgcaaaaccatcacaattttgaggtaatgtacagtattcaataaattacatgaagtattcaacaccttattataaaatagaccttgtgttacatcatcttgctctagtgtgggctactgtaagtgttctgagcatgtttaaggtaggctatgttaagctatgatatctggtaagcaaagtgcattaaatgcatttttgactaatgatattttcaattcacaacaggttttttggggcataaccctattgtaaattgaggagcatctgtatttaacacctccagaggttactgatgccctgatcctttatccacctcaggtattcaggttttcatattagtgtcctgattttcatttttaccaggacagtagtcctcaggccagtataatacaaacataaaaaggaagatcctttcaacctaaattttgttaaactcaggggtttagagattgtcttgtgtttgaatttgggctccacaactcttttatccacagggagaatgacgatataccccatattacctaagacaatcccaatttataactatggatccatagttatggatcaatatagttgtgattataactattgtaattattaatggcatcccctgttactcttagaagtatcctggtttttataataaattctataatcgctggatttttgatgttgaatgagtccctttattcctcatctgtaaattacaatgatgacactcctcttataggatgctgggtgcagtaacatgagcaataatcatggtgcatagcagatgctcaatctaggttagattcattgcttttaaataatgactgagctccctaaaaccaagaagaaaaatggagccagactggggaaaactgaataatttgatttggaagaaggtatttaaaagcagtatttagttggagacaagataggcttagtcaacttgccaacggcttaatgccaggaaggcccagtagggtcacagaatctcagaaatggatgaaaccatacttattatcaagtctcttccccctgctcatgcaaaaagcttcaacaatctgtgacaaagccatcacctaattattaatattaatggctaacatttataggacatggtgctaagcaccccaggtggattaccttaaatcttcttcattcgaactctataaggcagatactgtgattgcctcactgtagagatgaagagactgatctatggttgcatgagatttgcaagttcatgtagttagaattcagtatcttcattttgggtggctgaggcaaagggattgtttgagggcaggaagtcgaggccagcctgggcagcatagggggagggagggggggagggagggagggagggagggagggcgggagacagagagagagagaaagggagaaagagaagagaggaaagaaagggaagggaaggaagggaaggaagagaaggaagagaaggaaggaaggaaggaaggaaggaaggaaataattcggtgtcctgcctactagtgagcttttggttgccacataggattttgatgatacaattatgaacgtgaaatttgtatttgaggagttcaaaatgcccttaaaaagtctaaataattgacaagagtttctttattgtaaaggatgctttatttttatggattttatttggcaaatgttacttcctatttgctactagttttttaagcacaatgaaatgctataatatcttgaaacatagggaggacttctgtagttaagaggcaatgatgaaaatgacacattggatactttttccacaacaatctactggtttcagggcctgggagaatgtgttatctattgagaaatttacaatgcaatgaatggatagttaacagaagcactgaggtgtagtgaaaattgttcagggtttcacagacaaaacaacttaattcaacttgatgtgaaatagctgactgtgtgaatttgaaccagtaattttttttttactctgcaccttaggtaccctttctgtaaaatggaagatgggctagattattaacaccttttcaagtttgaccagcctctgattctctgaaatacagcctagattccttgcaaattgtcagtttggcaacaaacggtggtgcttagaaaaagctcagggcattcagtagaattcaattttatatgtcacagatggaagctaattgaaattatgtaggtagatcaagtgtaacaacaaatgcttgcaccagcatgtagcagacctttagcccagaactgcttcagtctgtcaacagcactgagcatgttgcagtaaagttggtaatcatctgtctttcttacagaaagtcattgctgagagcagagttttgttgggtcaaggacaccaggttgcttattttgaaaggaatcatgctcagaatctcgcaaaccaaaagcacttttccaattctgcattaatagatgtttaacttggcccagagcaggagcaacagtgccaaaagggaagcatgcccactaacaagactggactgtggcctgagactttgaagacttctagttttaacttccccctgtctgtatcttgagtgcctgcacctccaagagtttttttgaagcatgcaaatggtctgcctgctctagctccacttcatggctcttctctcttttgtggcatctaatgaggattacctcttgctgcttttgcctgcttgtgtctgttcatttatcttaagttccaggactgtgacttctgcccaagtggtcagcctaaaactgctctctccgcagttaaaaaacaaaacaaaacaaaacaaaaagcaaaaaaccaactagttatcaaaatcaattccattctagttatttattgattgcatgtagtatgctctacactatgcttgaagctgggggttcagaaaggattcagatatatcccttccttttccacatagagctgacatactcctggaggagcggacagatcaactatcctttatgtcaggagatgtactagttttatagaacagagcttctcaaactatatgtagtgaaggatcagttttgttccttattttttttctgtccaattcattgtacagtgatacttttgtaaaataaaaaataacacttatgtgtactgcaacaatatcacattgctgcgattgcttctaaatgcttacattcaatttctgcattttgttgttgtgaatgagtaggcgacaatttgcaaaacagcctgatgtgatttggctctgtgtcaccacccaaatctcatcttgaattttaacccccagtgttggagaaggggcctagtgggaggtcattgaatcatgtgggtggacttcctccttactgttctcatgatagtgagtgagttcttacaagatctgatggtttaaaaatgtgtggcacttcccctgttgctatctctctcctgctctgccacggtaaaacatgattgcttccccttcaccttctgccatgattgtaagtttcctgaggcctccagtcatgcttcctgttaaacctgcagaactgtgagtcaatgaaacctctcttcttcataaactacccagtctcaggtagttctttatagcagtgtgagaatggactaatacacagccccatcctgcagtcaaccactcaaggcagcacttgactgaaacagcttaaataaaatgctgttgaaacacacatgagtacacagttcatcccctctggggtatgagctctatctcagggagaaacaccagggaatatcttttagttctcttcttccttcatctttgcttcattcaaggccaacaactacctccatcttccagtccggttttactttgcttcgatcagattgcactaaacctagtgttctcctcccttccatataacacttttgttcttttgttaatatcattttctccttccgcttatccaatcacactggttcctcagcctggtgctgtccttacactctacactgactccttcagacttcttccaagcccgttgtgatcaggtgaagctcttcacacaaaggcagatagctctgaacacaccattactctgttacactcctggaatgtctgtgcacggtcactcaaggcctctttgatctaattctcacctaaattttcagttgttcttcaccacaatgattgaatccatttgcaatgctgcactgaagctgcattatttgctgttttccacatggatcctggacctacataccttcatgactataatcatgctttttgccccttctgccttaaaacttaccccacatcatcatcatttcccagtgccctgacttgccccactcatccgtcttcacaaataatgcctattccttaatacccagcttcaatgccacatctatcgggaaatattctctagagatcattccacatttgtaataatagctcaatctgctaattcccaatgtatttcattttgcttgttttctggcactaggtagggattgtctgtcttcagctatggtgatttgtaggcacatcacttatcatccatgtaggctctctgaggtcagaattcatgcattacttactctctgtaagtgtctcacacagtgccctgttaatttgattatttattcatttgcaaacacagacgtttttgaacctataatgtgctgttcacatcttaccaaccttataagaacttatcatctattgggagaaatcggataacaaacatagttatcaagctatttggcaagtgcaaagagtgttttgcactgcataatacagaagatggagagaggatgcacagccagcaatgcagatgaccatgtgttcagggagtgtttctttagaaggcatcattggaggcgagagtaaaaagatgagcaagcccaagataggcacctcatagctacctgattgctattctatttgatttgattcctttgcacagttctgagagtcccactcagatttcctctctgagtcttcttcgcatacttacaggcagctgtaatctacttgttgtatacagtttacagtccatttaaccaaccagaatttcaaataaagcagtataagcaactgtattgggttaaatagtgtccacccaacattcatatctacctggaagtcagaatgtaatcttatttggaaatagggtgtttgcagatgaaattaattaagatgacctcatcgtagatgaaggtggtcaaatccaatggctggtgtccttataaggggagggagatttgaggatagagagacacacatgcaataggaatacagcctttggaagacagaggcggaaactggagggatgcagctatcagccaagaaatgccaaggactgccagaaactcccagaagctgagaatccaaggaagaattctctcctggagcctttgtagagttcattcccctgcttgtgctttccaggtttgttctcagacttgcagcctccagaactatgggaggataattattatttttaaatttaatttaagttccaggaaacatgtgcaggatgtgcaggtttgttacataggtaaacgtgtgcaagagtggtttgctgaacctatcaacccatcacctaggagttaagtcccgcgtgcattagctatttatcctaatgctctgcctctccctaatcccctgacaggagagtcaggggagtgggggaagggagcatgttgttcccctccttgtgtccatgtgttcctattgttcagctcccacttataagtgacaacatatggtgtttggtttttctgttcctgcattactttgctgagcataatggcctccagctccatccatgtccctgcaaaggacatctcattcctttttatggctgcatagtattccatgctgtatatgtaccacattttctttacccagtctatcatctatggacatttggcttgattccatgtctttgctattgtgactagtgctgcaatgaacatacaggtgaatgtatctttataatagaatgatttatattcctttggttatatacccagtaataggatttctggatcaaatggtatttctggttataggtctttgaggaatcgccacattgtcttccaaatggttgaactaatttacatttccaccaacagtgtaaaagcgttcctattggggaataaatttatatggtcttacgccacccaatttctgggaatttgttacagcagtcctaggaaactaatatagcagcctcaagagataatgcatgtacatcctcattcttaatttggcctgactatcatagaaatgtcttctcctttattgtcctagatggcttaatttctacagagcgctctgctgattttgcacaaattggaggcatgccaaaattctcttaaagggctatgaatttattcttattttcttaatgcaaaaaaattaagtaaataactatcatttaagttaaaaatattgttttatcacattttccaagtattaaaacttttacattctttgtatctatgtatgttcctcgcacaaagttgttccaggttcagtatacattttgtcaaattgtacccaaggtgctatttcccaaatcatattgcttaactgaatgagtagcgttacttttttatggaaaatatccaagtttgtgaatatgtacagtaaacatttttattaaaatacattgtaaagatgaaagttctaatatttcttaaaactgtgccttggtattgggttggctcttttgtaaaaaaagaaattgaaattactccttttctggtagtagtaggagaccattgggttcttctcagtaggcttatcatatacatttacaggaatatttgaaatgataaaaactctgtttagaaatttctgcctattcttgaaaacatcactgtagcattcatttcatttgataaagatgtgaagccatttgtcaggaggcaagagagagggcggcaaggaacttgaaattgcaataacattaataatttgtggaagctttggtctatttattgttaatgttcaaaccttgtgcacagatgcctgactttcccaatctgtggtcaatgtcaagacatagataagtgcatgcactcaatcagaggaagaaaggaagctggccgatagacaagggcacacataaagtatatgaacaggttaataatgctttctttaatcagctggaattaactgttctttaccccgatgcttgtatttgacaggcggccttgattcaccactgccgataaattgctgggtagaatgaatgcctcagtgctcaggccctgtcatgtgttggagacaaatgtttttgttcatttccctggtaagcacaggtacaaattccttaacaaaggctttaactttaatggtgtaaagtatctgtgtcactctgaaaaaggtgttgtgcacacagaagagaaatgtaatcgatttgttgagttaaaaaaataaacatatatcatgctttaattaagacaaaacattttaatctacctataaaatagttctttatcaatgaccatattgccatggactttatcattgactatacagataaaaagaaggaattcaataaaagaaattgttcaataattgttaaaatgattggctactgggactatgtctaaaataggcaaaatatgtccaaatttaagaatgatttttacatataattcaataattttaatgtatatcaattatgaacaaaatataacttattcaacaaattattattgagaatttactatgtattagaacacttccatagatctgggatttaattcattgctgatgaaattatagaagaatttatttcattcatttattcatatgttcactcagaagcattcttagagcacagaccctgtgcaaagcgttaagagttattcttgccttcgaagaaatttcccagtctagtacagaagatggataagaaagtaattagctaaaatgcaatatgatgtatatgtatatgaggtgcaatatgatatctgtgtacagaagtatcatatatgagatttggtgataacagcacagggacagcagagagaatgaggggattaccgaatgtaggtctgagtgaaaggaccaagggaggtggagaggttcactgagggggcaacacttaatctggaatttgaaggatgatgaaaactttactaaaagaacatcagagacaagaagcattccagtgagagggacaatatgtgcaataaaagagaaacaggaagcaggaaaacgggtcacttgctaggttgatattactgatagtaaggtgttagccaaactggcctgaaatgcaaagaacagagaaataagcaaagatcaagtaagacaaagattgggaaatgtccactgagtttgggatttaagttgtcactgatgacatgtgaaaaagctctttcagtggggtggaaggaactgaagccagaatgtagtgggtggtgagattgtatgtccaaggggggaggcccaacccacatcacctgaacacaaacgatgtctactaaatacttcctcactgtttaacagatacatccatagtattttaatgtaaatacaagaaagaagataatacgaggcattaagaagcaagggtcatagtttgggggagatttctgagtatatttatagaattgttgccagggaaaaggtagagggtgaggattcagaagagagagaggctgaggctcaaggaccagagcccaggagaggtggttaaaaaaccaaagaacaaagatattaaaaatgctggtagaaagataaggcttgaagcagaaagaacacatttctttctcagtctgttcatcaagaaacatttataggacattttctatgacctggggactgtaagatttcttagagacattcataaatcctacctcttgtcactatgcttctaccttaatccactgaccttcaaaatatttttattacattaaaacattattatatataatatagtatataatataattattatatattatataatatatattacactatatagtcaatatgactttgagatatccataactaatatatatcacatataactaatatatattatatattatgtaattatattatataaatattacatataacatatataacatatattatataacatatataacatataacatgtataatatataacatatataacatatattatatataacatatataacatatataacacataacatatataacataacataacatataacgtatattatatataacatatataacgtatattatatataacatatataacgtatattatatataacatatataacgtatattatatataacatatataacgtatattatatataacatatataacgtatattatatataacatatataacatatatataacatatattatatataacatatataacatatattatatataacatatattatatataacatatataacatatatataacatatataaattatatataacatacattatatataacatatataatatataacatacatcatacataacatatataatatattatataacatatactatatatattacatataacgtatataatatatattacatataacgtatataatatatagtacatataacgtatataatatatattacatataacgtatataatatatattacatataacgtatataatatatattacatataacgtatataatatatattacatataacgtatataatatatattacatataacgtatataatatatattacatataacataagaatatatatatgttatatatatattttagtcagaccctcactgtcacccaggctggagtacagtggtgcaatctcagctcaccacaacctctgcctcctgggttcaagagattctcctgcctcagcctcctgagtagctgagattacaggtgcccgctaccatgcccagctaatttttgtatttttagtagaaacagggttttatcatgttgtccaggctggattcaaactccagacctcaagtgatccacccgcctcggcctcccaaagtgttgggattataggcatacgccaccacttctggccatatttttttaacgtataaaataaaacatataaggttaaaaagaaaaccaattatactacaaagcagttatcaaaatattaaaaatacacatgtagatcaggtcttataactactataacataaaagtagtcaatataatgactatttgagaaatccgtaactaaacatatttcagtgtctattggctatgaagtcacaggtgctactaataatactgtggtttgttctctacattcacaattaaatgatatgctaaatttctgttgaggttaatgaaaataaagatggcatgctctttgcacttaggtttacagacccctgaatgctctgatccacctacccaggataaggctcctgtgctgatgggagcttgagaactggctcctggctctctctctctacctcagttcctccactcttatgctcacacacctcattctagttacctcagccttcttcccttttgtcaaacatttggcgagtgcttctgcttcagggattttgcatctactaggctttcttgtgtctacaatgttctccccagatatccatgacttgcttcttcattgtgttcaagtcctcatcaaacgtccctcctcagagatgccaacttgactggcttatagtatgacccactccgtccttctctactcatttaccatgctatatttctcttgacaacactcatttacctaacagcgtatcataaactgtcagcttatttggttagtgactcccctactaggatgtaacttctatgaggcaaggatttctttggcttaacaatatcacagtgactgtcacatagcaagggctcagttattatttgttgaaatagatcatttcaactggctatggaaagtgcttacatgtgaggcatatccattatcctggggcctcagagaggaggaagtactgcttctaggagaaggcattgcctaggtacagtcttgagatcattagagattcaaggaaaggagaaaattgaacatatcagttggaaatatgtataggttctgacctagataaggtctaaagtcatgcttaataaaaataaatggccttgctgggcacggtggctcatgcctgtaatctcatcagtttgggaggctgaggcaggcagatcgcttgagttcaggagttggagaccagcctaggcaacatggtaaaatcctgcctctacaagaagatacaaaaataaaaataataaaaaatggctttatcagtcatactttaatggtcttaattttgcattttatccctactccctaaacttttttctttaaagatcttataagaagcaacccaaaataggcatatataaataatatagatggcaatgtgaatttcacataagcatttaggaagatgagttccattaacaaagaactggactggtgacatttgtataacattgtattgatacaaccactttacttttcataatgtcaatttcatttatttttccactaaaacatattacaaccattcaaatgaatgaatggaaatgcaacttttgagtgactccactgatttttcccccattcaaatggtttttggattcttatattaagcagtcttgagataagcttcattttatgctgatttagagagtgtttcaagatgaaatgtcagcaagccttatctgcaaacaccagatccaataagctatatctggtactaaaaatcagaaattgacacaattttaattagcctccagttagtgaacagatatttaataaatggtcacttcagcttaccttttaagatatacattcaggccgggcgcggtggctcatgtctgttatcccagcactttgggaggctgaggtgggtggatcacaaggtcaggagctcaagaccagcctgaccaagatggtgaaaccccacctctactaaaaaaaaaaaaaaataccaaaaaattagcaggtgcctgtaatgccaattactcgggaggctgaggcagagaattgcttgaacctgggaggcagaggttacagtgagccgagatcgtgccactgcactccagcctgggtgacagagggagactccatcatggaaaaaaaaaaaaaagatatacattcaacgggtacaaattattctctaaattacagccctttgtccttcaagagcatattataaaaccacagaaatgaacataaacagagaaaatacctgaagatatataacaaacggttaatcagtaaataattaattacgtactttcattctttgattctacaaagattacttgatgccagaacaatgctgggtgatgtgctaaggtgctggagatataaacgaaacaagttagacaaggtgcttgtctcatggagcttattttataacgagggagatgaataatgaacaaacacatatataaacgagttcaggcacttacaagtgctataaatacaatcaaataggtaataacataataatgtaattttggtccacatagatctccagtctcttagcgtaaagacaacttaatttaattcctggtcctatcaagccctcacacattaaaagtagctgcctgttaaagaagaaaagagagaagaatcaaatacacgcaataaaaaatgataacggggatatcaccaccaaccccacagaaatagaaactaccatcagagaatactataaacacctctatgcaaataaactagaaaatctagaagaaatggataaattcctcgacacatacaccctcccaagacaaaaccaggaaaaagttgaatctctgaatagaccaataacaggctctgaaattgaggcaataattaatagcttaccaaccaaaaaagtccaggaccagatggattcacagccgaattctaccagaggtacaaggaggagctgttatcattccttctgaaactattccaatcaatagaaaaagagggaatcctccctaattcattttatgaggccagtatcatcctgataccaaagcctggcagagatacaacaaaaaaatagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattacctcaatagatgcagaaaaggcctttgataaaattcaacaaggcttcatgctaaaaactctcaataaattaggtattgatgggatgtatctcaaaataataagagctatttatgacaaacccacagccaatatcatactgaatgggcaaaaactggaagcattccctttgaaaactggcacaagacagggatgccctctctcaccactcctattcaacataatgttggaagtgctggccagggcaatcaggcaggagaaggaaataaagggtattcaattaggaaaagaggaagtcaaattgtccctgtttgcagatgacatgattgtatatctagaaaacctcatcgtctcagctcaaaatctccttaagctgataagcaacttcagcaaagtctcaggatacaaaatcaatgtgcaaaaatcacaagcattcttatacaccaataacagacaaacagagccaaatcatgagtgaactcccattcacaattgcttcaaagagaataaaatacctaggaatccaacttacaagggatgtgaagaacctcttcaaggagaactacaaaccactgctcaatgaaataaaagaggatacaaacaaatggaagaacattccatgctcatgggtaggaagaatcaatatcatgaaaatggctatactgcccaaggtaatttataaattcaatgccatccccatcaagctaccaatgactttcttcacagaattggaaaaaaactaaagttcatatggaaccaaaacagagcccacattgctgagtcaatcctaagccaaaagaacaaagctggaggcatcacgctacttgacttcaaactatactacaaggctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaacaaatggtgctgggaaaactggctagccataggtagaaagctgaaactggatcccttccttacaccttatacaaaaattaattcaagatggattaaagacttacatgttggagctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacttactcatctgacaaagggctaatatccagaatctacaatgaactcaagcgaatttacaagaaaaaaacaaacaaccccatcaaaaagtggggaaggatataaacaaacacttctcaaaagaagacatttatgcagccaacagacacatgaaaaaatgctcatcatcactgaccatcagataaatgcaaatcaaaccacaatgagataccatctcacagtagttagaagggcaatcattaaaaagtcaggaaacaacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggactataaatcgtgctgctataaagacacatgcacatgtatgtttattgcagcactattcacaatagcaaagacttggaaccaacccaaatgtccaacaatgatagattggattaagcaaatgtggcacatatacaccatggaatactatgcagccataaaaaatgatgagttcatgtcctttgtagggacatggatgaagctggaaaccatcattcttggcaaactatcgcaaagacaaaaaaccaaacaccgcatgttctcactcataggtgggaactgaacaatgagaacacatggacacaggaagaggaacatcacacactggggactgttgtggggtggggggaggggggagggatagcattaggagatatacctaatgctaaatgacgagtcaatgggtgcagcacaccaacatggcacatgtatacatatgtaacaaaacctgcacattgtgcacatgtaccctaaaacttaaagtataataataataaaatgaaaaaatttaaaaagtagctgcctgtagaagacaggaggattcctgcattcttttaaacatgctagccatctgcagcagataacagaccccatgtagcaaaaattcctttttgaaatccagtctcatcagcaagttactcaggcaaataattttttcaccagcaattttcccatcccctttagtctgttgatgttgctttctcgtcctgagctttgagtcctgttgatttttcttaagaaatcctagatagggtacaatttattagagaaggcttcctggcttccatgtaacagtgtggaaactgatggcagattgaactggagaacatggaaaaattacctcctaatagtgcagccaactcaaaagtaccttccccagcatttctgaagacaatgcaaaaatatgatgccttataggcagccatgcctcagaacattattgaaacacttgtttcttaaaaatttacatttgctttaatgttgaagtttttcttctcaaagtctactgtaaaaaattaatgagatgcagtcagatggttatccataaaaatgttcatttcattgtaatttataacacaaaaaagtgcaaaataagaaccaaattaggccaaaataaggaactagttagataaattaatatatatccttattttgagtgcttatatactggcatactacagagtcactacatgttttgttgctaaagaatatttaatgacatggaattttgttgatggtagagtttggtaaaaagacaaaaaaaaaggaaaaagaattttctatatagtatgtacagtgtaattcaaattgtatgtttgttcacagaaaaattagtgagcagatatataatcaaaaattaatagtggtcaattgggtaacttacaaagcaacaataacctttttgaggcatttctcaagacttaaaaattttttttctaaagtttatatgggttttctttgcaatcagttaaagatgttattttgaaatgcttcttcttttgagtggtgaacacttcttgaagaggaaatgggttcattctttgacattcacagaggggttagaatcaagtcagaggctaatggctgagtcaccaggtaaggaaggtgtaggcaagagatggaaacatagaaaggggctcatcgcaaactccagtcttttcagaggaataagccagctgacgtgaggaactgctgacaaatgacactaatgaatcatagtggcattgggaattagcttgggaggggaggttaattcatattgtgaagaaatttagtgtgcagaatttgtcattctctaagatgaaatgggcattatttttagttttcttttgtttaaagctctgagtggggccttgaggtaccagctagaagttccagggcttgagtcctaggcctcttttcttggatttgctatcaaaagtggtgtggaatatttatccgcaaaaactgcagtatgctcgtctatatcatgggattaagaatgtcttcttatgttggccgggcgtggtggctcacgcctgtaatcccagcactttgggaggccaaggcgggtggatcatgaagacagagattgagaccatcctggctaacacggtgaaaacctgtctctactaaaaatacaaaaaaattagccaggcgtggtggtgggtgcctgcagtcccagctactctggaggctgaggcaggagaatggcgtgaacccaggaggcggagcttgcagtgagccgagattgcgccactgcactccatcctgggcgacagagcgaaattctgtctcaaaaaaaaaaaaaaaaaaaaaaagaatgtcttcttatgttccttaactctcagggttgttgggagggccaaagaaatgtgaagcatttctctgagcatatactatacatcgataacccaaaacaacactccaaacaagcctacattaaaaaaagaaatctttgctatctgtaaacactgcacttagttaagaccttgagcaaatacaatgcatttttttgagactgccttatcagcggtaagataaggataataatagtcatggtggttagttttctgtgtcaacttgactgcaccaagaaatgtccagattaaatgtcatttctgggtatgcctgtgaaggtgtctccatgtgagattagcattggatcagtggactcagttaagtagattgccacctccaatgtgtttggggatcaaccaatccattgagagtctgaatagaacaaaaaggtagagaaaggggaaacttaccccttttctttctcttgcctgcctttcctagctgggaaattgttctttcactgacaatggactaagatttacaccattggctcctctggttctcagacctttggacttgaaatggaatgaaatcaagggttttcctaggactccagcttgcagactgcaaatcatgaaacttctcagcctctataattacatgaggcaattcctcaaaataaatacatctctttctcacacatgtgtgtgtatctgtgtgtgtgtgtgtgtgtgtgtgtgtgtgtgtgtgtattgcttttttcctctggagaaccctaactagtacaacagtaaccagtcaacaagttgttatgatgattgaatatatcaatttatataatataccaagcagaatatctagcacatattagtgatcaatatttcttatcactaacgttattatcattatcaatatcagatttatagatattattcttaataaagttataatttccctcaaggttattcaaaccagtagctgatatttctctcaggtgtatttattctatgaacagtaataacttctctacaatagaggcctctctttatgatacatataagaaattttcattaatttattgtgatcatcaaaggtacaataaagacttcaaagtagaagctgcttcagttggtacagaaccctttatagaatagtttcacaggtagatcgagttctttttactgtttaaagatagaaatgatgaaacaaatttatattttggtggaaatatctttgttaataattattaagcagatggcattgtacataaagtttgcaaagaagcctactaaaatacagattggcttccttataactgggcttatcctcagtgtatcacagaatggtttagaacctgggaatgtcagcattagaatggggcatggaggttgactagtccactttaatctatcgtatcaacccatttattagagccttatatgcagtaactccagaactagaaactctcagctgtaattatcagttgcattaaatgctttccacagtgcaggaaacaacacataaccaaaatcaagttccccatgtactctggctcttccatagctagtgatatgaagctgttcatatctcttgattgtctgagcataatattactgatgattacaaaaccaaaaatcaacaaaaaccctgtttcttgagagagcatattgcatgctagaggcctcggtgtttggagaaaattaatggtcagttttttggagagaaaataacatgtgccaagccccacaggtgaggagtatagacttcacagcaagatcatcgaatgtctcaaggtaaggagagctcagaaagttgtagcaaacatggataaattgctagtgaggcaagcacttgctgaaatggctttccatagaggagtaagaaaattagcactggcccattcggttaacccaatattttaacaaaatgttcatttttactatcattcatttttaaatttatctttacttgtattgatatataacagttgtaatagattgagggtacacgtgaaattttgatacctgtataaaatgtgtaatgatcaaatcagcataattgggatagtcatcaccccaaacatttcatttttcttgctcgtggaagattaaacaatgctggcaaagaaatggtttcctttcctgccacttttccatgaaaaccaggctatagatggctaaaggccaatgtcactcctaaaacagtttcattataagtcattcagcaatctgaatactttattgttgcatttcagatagacaaatgtttactatccatgatgctatattacaatcacagatattctacatttacaacagtaggaagacataattttggaaaaagctgtttgcaattgactgtggatccattctatttataatattgaatataaacatgctaatactacagagaggaaaatgtcttcccagttgaattccctaacaagctgagacatagaatattaattctgcaccaatgttgatgaattctgattctaaaaatatttcttttaatgaatcatgaaattcttaagtttcaggttcgttgaaacaattagaatatgtttcagtttttagaacaaatgctttattaaaatgcacatttaaatgagacacttctctaagacctgatactttaagatgctaagtcctcaataacaataattaaagcttacatctcattactaataaagtgaaaaattgaatattgcttatgcactattaaaattcaattttattttataaaaaagtattaaatgctactgaatcaaaagtcaacactgattgataatttgtctgcatctattacatgaaagctatggccaaattagggatacaaatagagaaacacatgcctttctatcgtatacgagtaacaacccagggcatgggttttagtgtgatgaagatgtggtctcctatctcagcttcatgacttatcagctatttgacctagggctgcattctttagcttagctttaccttttattaaatgtggccactaatgcctaccacagtaacttgctgtgaggttaaaatgggaaaacacatgtcattttcttgcctttcaccagggagtgagacataaactgtttctctgtagggttactcttatcttaggccttcacttcctgccttggccgcatcacattcctccattataaacactttttcacacttagaagaattttacttgctcatttgttccgatttgggggtaagaagatagatattgcaaatttaaatataagctccatgaatgcaattactgtgtttcatttgcttttgctttgctttttcatttttactcaaacttttgtattttgtgcttctgctgtgactgtcatataataggtgcataagatgaataataaatacttgttgaataaacaaacacgtaaaaatccctgtaggtcatgggtgatacatttttaagaggggaataatattcaaaactaacaatgaaggtcaaatgagaagaagtggaatatgtcagaccaggaactaggaattcaggagaagtgtctggggcaacaccaagaatgagagtatctgggggaagcacgtggcagacagacccaggtgaccgtgcaaatcctctatcgctaacaacaaaagctttagtgaatgtatccacagcattactttgaaattcaaaggcaacacgtagctagggtgtcatctgcaagtagcaacatttctctattgatactataaattattacataaaaactagcaaaggaagacaaggatagtctttagagattttgcaaatacccggaggagttttcttaatgaagaggaaatattccgacatatgacagaaatctcataaccaggtataagcatcctataaaaaaaggaggattttttttaacttacagagctgtacctctgtagaacacgatagctaattctgctgcacattaggcagatgaagagacctgattcttccagtctacagatgggtcacagtcacatttgcaagagtagtctgtcacccagaaatgtggaggccaacagagcaccagcccaggacaccctttccctacacacaggtggcagaaatatgtggccctggcttgctggaagttctctactttaaaaccaactagcttctctctctcctgagtcccaaaagacagactgcctggcagcctcaacagctgttgcaatcacgccagtccagaggggaagagacccacaaaaccttcaaacacttcgaagcttaagctgattttgtcaactagaatttagttttacatgattcatcatttgaaccattactgcaaaatacttatgtgtgctaaaagaaaatctttgaagacctgatgcctaaatcactgaagaaccattatcgatttaggccacacagttgctatgagctgtttttgaatgatgctatttttgcatttttttccctcaagcagcaggcaattttgatacacctactccttgccaggcactatgttagccttagagattggaagggttaaacatagtgcaatgcttccattgtcacaaaataaagatgctgggcccacagatgtaaggtaacagatccaccactgagtaaaagggtttgattgtaaaagttgaaaaaataatgaaaaagaaaaattagttcttcagaaaataagaatgtaaaattggacctaatttttcttttcacaagcactaatagttaaaattctgttcataagtgaaacatagactctcaactattatcatttaaaatgcaattatgaaaatataataagtaatttttcatttcttttttcttttgtctaagtttctctacattatttattaattagttcttgcaaggatctcaagagataaggattatattgctaatatcctggttgtagagattttaataacttaactcaaatcagcaaagttaagattaaaataggaatgaaatgaacaagggaagttattttattgtataaaagaatttcagagttggaagaggttttgtagagtacctaatccaacctttgcattatataaaataagactgtgaagatgagcaacttgtttataggtcacacagttgctgacaggtccaatttcaaaaccacctcaaattactgtacatttctcattgcttctgttagccatccataccagtcattgcctaacaatttaagactagatactgggcaaggtgttgtgattttgtgaaccagaaatgcagttcttgttcattaggactcttctctataggagggtacaataaagggtttgaacattgcaatggaagagcaggaaacttcatgaactaagagagacaggtgtagttcttgttccctagaaataaatcccaatatgcatgcagagggacgatatggcccaggaacatttacaagaaatatgtatatctatatatttatatagatataaatacatatatatatatatacaccacagatggtatatatatttatatctatatatttagatatatctatatatttatatctatatatttagatatatctatatatagatatatttatatctatataaatataaaaagcaaagcaaaagcaatccacaggtggatatatatatatatatatatatatacaccccacaggtgttttttatatatatacaccacaggtggatatatatatatatatatatacacacacacacagacaccacaggtggagatatatatatatatatacacacacacacacacaccacaggtagatatatatatatatatacacacacacacatatatatatacacacatatatatatacacacacatatatatatacacacacatatatatatacacacacacacacacacacaccccccacaggtggatatatatatatgtgtacaccacaggtggagcatatatatatatgtgtgtgtgtgtgtgtgttctgcacagcatgagtacacatgcaataatataaaataatataagtggtaagggccctggtcactagagattgccttctgtatttaaaatgagagcaaccatactcaggcgtacctctctcttgccttgtgtgggcatgagctccatgtcaccagatttgattttttttttccagagacatcaacagtatagactttaggagatggtctaaagctcttagcttggttgctcgcctgagagaagcagagttagaacaagtgaagtctacccagttagcaaaagcacaatatataaagatcgtctttaaaattatttgtgtttaaattcacaccttccccttgggaatcttcgcacggatttgctaattgggtttctctgaatattcagttgttcaccgctgactgactagacttcccaaagccttgataactggagaatttccaaatgctgcatttttttcagccaggcagatggcatggtaatggtagatgtgaacttatgtcctttttccttttatagcagtgcctgagtatctgactgacctactgggattaatttactcttacaataggtgataatagagcccaattccagaagtggggtgctcagcagttcttgctaccatgtaccattttcacagccttaatgtgggaccagagcagtataagggcttaacatatattttctcctttattcaaacattactcctaagtactattattgttcaaattcagctagaaaactgagactcacagaggttagttaaacaactttcaaagtcaaacacctattaaatggttgagagtgactgaaatctggataccttaattttaaaagtcagtgctttcgctgttgtatctccccatgaggccaacccaagtggtcaaccagtaaaaaatttggtaagtatcatgtgattttctctacaaaacagtgaacaatctagtggacaacatttttcttttcagtttaaactagaaattcgtattttctttaaagtgtaaggtagaaatgactagatttcctggtatcttgtaaaggaggcaaaatcaacagtaagaagggggctaatattttcagtctctggggaccaattattacattgggtatacttccattataataaagatagatatacaaacatgcatgcatacatacatacatataaccatatcaaaaacaggcttgggtaacagaaaactaacaggaaaaaaatcctatagtttgaaagggaggtatcgaagttcaaagtagcactctctcttccgatgcattagtgatggtgttggaaatggcagtgggctggggaagggtaaaagcgatggtatgtatgtattaaggttctcttcctctaaccttggaatcacattaagtttcaaatacttgtcccataccctgctaactctatgaattttggcaagcaataaccatgtcaggcctttttttcgttgatcttggtggaaagaataaatgaaataatgtatatcaagtgcctgacagtgtccagcacagagtaggtacccataataatcacttcttctctttcctcctcctttactgattctctgctcagcagtggaggagtttcaaagcatggggcatattaatatggtaagattatttgaagatgttcatttagaatatgcaccagtattttcatttaaattagttcactcttcaaatcagcatggtgctccaaaaggtaacaatgttttggcgatgaatatgtgccagcaacttggattattttaaggcttgtataatatttatctatgaaaaaattttcccctttaaacattcaataagctcatagccatttgcttaagtattccatccaagcataaaagcttcccaatgaacgagagcactgtcttgtgacaaagcttatttctgtgtatttttaataagaaagggttcagaatggtgatttcttgatatccattcaggctttgaaaagagatcttatccaagcaatacattttctgaaagtgtaaagggagtggtaaactgttcagaaagggaggaggatctcatttctttctttttttttttcccccaggaaaaagttctctgcaaaaccacaggtggacataaaagtatccagacaactacactctcgcagagatcttaggactgttaaaaaaaaaaaaaaggaaatatacatatatatgcacaaaattgctgataaccataataaaaataatgcagaaattctccagacttggaaagtttaaaacattatgaaacttcttccttacagttacatagcacaattatttgtgtattcagctctgaaattttcgtcttcacaaatgacagtgaatattctgctgtagcagatgcttaatccattaaataagtgggagtcactaaaaaatccctgtctcatgaagtggaatcctactatttggctgaattttcctctggttttccaggaggaatacgcaggatacaaaatttgatactgacttctttatggtatcaagagtgacagttacataaaaacatatctggtctttctgacttttcaaaactatatttttacttaaattacaaacagaaaacagattttcatgttattggctggcgattttatgggatggaggatttaacagagctgtgatttagaattaattgtttgcttttctaaaaaaaacatagtcaacaactaccctaggagatctgacccagtaggtacttaaagcgaggatgggaaaggctgtattttctttttaaatcttctcagaaaaagtagcaatatatatcaaacatatgttaaaatagtaaaatatatgtaatataaatatatattatactcatatatgtttctatattatatgcatatatttaaatatacatatacaaatatgtatatatctacactgtatctcagaaattatctacaaatatgtcatttatcttgacatgtaaaagtacacatatacagaactgttcatgacagctttttttaaattattgaagaaatagactcaatttgaatggccaccagtggggaatgcgtttaaacgaattatgatacagccatataatggagtgccatgtaactagtagaaacacaatgttagatttatatagttgaaatagattaaataaaagctatccaacaaatctatctatattgttagattatggtatattgtagagtaaggcagaaaattttaggaaaattatacaggagaggagatctttattttcatcttaattccttctctgtgagctaaatgctattgttttcatttgtatttgcatgcattactttttactttaacggataaaacaaattaaaaaatgcacacagcaatcctgatgttcagccagtaccgagaacactgtggccctcatatcatgttaaggtgctagaacaaggtttaatcactagagtgtttgttgctccatcaacctaaaatattaatacaaattttgcccggggtaaaaaagtattcatttcatattaagaatgtttcaaaatattttgtttcaaaacatttttgaaacttaaaatgttttgaatcataaagcaaccttgagtaggtagcctacagaaaatgtggcacatatacaccatggaatactacgcagccataaaaaatgataagttcaagtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctagggactgtggtggggtgtggggaggggggagggatagcattaggagtatacctaatgctaaatgacgagttaatgggtgcagcacaccagcatggcacatgtatacacatgtaactaacctgcacattgtgcacatgtaccctaaaacttaaagtataataataataataataaaagaaatataatgggaaaaaaaacataactgagatgttttgatgttttaagtaactacctgaggtatgtttaagcaacatttaagtaacatgaatgaggttttgtttttttttttttttttgagacagagtctcgctctgttgccaggctggagtgcagtggcgcaatctcggctcactgcaatctccgcctcccgagttcaagcgattcttctgcctcagcctcccgagtagccaggattacaggcgggcacctccacaccctgctaacttttgtatttttagtagagacagcgtttcaccacgttggccaggatggtctcgatctcctaacctcgtgatccgcccgcctcggcctcccaaagtactgggattacaggtgtgagccccttccctcgcccggccaaggtatgttttaagtagactacctgcttgaggtagatttatgatacatacccattatcgtgacaatgaaataaaatgaaatgtgatgagaaagtgaaccattccacaccatcacctaagcagggcagcacacgaagacctgatgtaacgctgacaatgttaacacccctgtgtgatgtccaactaaaaataataaaaaaagaaggtgaaaaatttccccatgctgtcaatcaataatgatgtcatcatgaccctgatagaaaactcagtccaggaggttgatggtactaaattagaaatatccatctttccctttggcaaatcctcttttttttttttttttttgtcgtaagtattacatgctaaccttgtaatgagagggcagagaggtaatggggaccaacagcaaggaccctctggaagcctagagccttgggtcccatcctaaaagataagcactgagcacatcacacttaacctctcagcatttcaactttcctatcatctatgagatgagaataatacttgctatctaccccataaaggggttgaaagggatgctgagaaagtccatggaaagcactttgaacttctcagaagtaagattttacagaagtacaaagcctcacatcaaaagacacactcatacctttctgtgacatcaatgagtgtttcatagataggattatgcataggtctgacgctgaatgtgctttatcattaaaataatttctacggcaatttcttttctttttacctggacatatgaatgcatatgcagccttgacaaatcttatactccttctcagatcactgtgaggggtctctgaggctcatttttggctcaccaagctgtgttatttagccaacaggtataaaatgtggtaccccctacttctatctttaggcattgctagaaagtaatcttctggagaaagaaaagtagaataaatttcagtaggttattgatgacatcatgtgttatggccatatttgacacagaacagaactaattcattcaaactccttgttagcaccaacctcttctgaaattacagctgtttctactgctatctagtctacattattaagtaccacctgtgcactcagccctatagaggaatgttccatcagtcttggaaaaggaatttgtctgctagatagtgttaaaattacatagccattcaaatctttcttcgataccttgaaaatagattcttaatactggctatgtattaaaatcacctgagtccactggagaggagctaaatcataatctctgtggctgcttctgccacacagagatgttttatgagattccacatgtgcatgttaatagcagcactactcataatagccaagtagtggaaacagccaaatgtccatttgcagataaatgaataaaccagctagatatgtgggatgttattcagatgtaaacaaataaatggattactgatatgctacaacatggatggacctcaaaaacatcacactaagtgggaaaaaaagacacaaaaggtcacaggttgtgcaattccatttatatgaaatatccagaataggtaagtgtgtagacacagaattcagatttgtgattgccaggggtaagggagaggtgagaaacgaagaacaactgcttaatgagtatagattatccctttggtatgataagaatattttggaactagattgaaaatgttgatgcatgacattgtaaatgtatatatatgcatacatgcatacattcagacatagatttccaggtgtttacaaagcaatctgtgctaagagtcatggtctagagtttcaaacatggttgttgcaccagtaccattgcaactgtacagtgctggcccagtactatgcattgccttcaatcaccagtgcatttcttaatgcttttcttggtgtgacatagggagcatcacctgaagtactgagcatcttatatgagcatcacctggagtatttgcttgtgatgaatgcatattcccagtcttcactgcagacctacagactcataatctcataggagtaatagggcacggttatgcatttaaaatcattcctccaagttattcttatgcatttcatttttatttttaattgacaaataaaaatgcactacattttaaaacttgaaggccctactttggactttgccttactcttccctatttatcattttttgagctttattcatgacctacctccactgcttaatgctgagtatccattatctcttttaagcttcacaaatgacagcagtcttcatttataggagagaaaattaaggctgagaagaggaaaatgagttgcccccaagagttcacatttagaaactggaaaaacctgtaaccaaactttggtttttctcagaaaactttaaaccctttactctttcacaccttatcccttccaaggaccagttcctggtctctcattgtcccattgtcgctatcttctaatatttccctgtaatcatcgcagtcaccagataatcactgccacccgtccccagactcatcaactgatgaaccactattttcaatcatcttttcttgaaatttccagggctatttgacttcaggtaaagttgaccgtctccactttaacctgttgagaccaagtcagtcttgaatgagctcctctacccccaccctggctgttgcatttaatctttgcacctccctctgcccattttgcccaactatagagggagacgaggccctacctgtgtcccatcccttctcactacctgagcacccttcctcccaagctcatgcccccatccttgactctctccctctccatgaggtctaatatgacctttgattaaacatgcttaaattgtaccccacttccaagtaataacagctaagtttaaaagccgtgttgcttcttctttcttaaatattatcttatacctatcctttgtattttttcatcaccagtttttttcttatctcccctctcctcccaatgctgctctccttaaagttatcaaaaatccatcttcaggccaaatccatttgtcaatgttcagttcctcctcaacacctgcttcatctgacatttaatctccttaaactctcccctccctcagcctcagcctctgggtgatcagtctttgttttctttttctttttatttgtctcttctccagtaagtcccttaaacttttctgacccttagtatctttacctttaaaatagaaaaaaaaaaaaactaattcaggatgttgttatagaggctcaaccaggcaaaacctactttgtgtatgtgctcattgaacagacatttgttgcacatctcttgtatgcacagtactgagttaaacactggggtataaagatgacattgacgcggtccccaatgttgaagaactgtaaattgacttgaagaaacatgttgacaataacccggatgctttattcattcatttattaattcaattaattttgatcaagtgcctataatatgtcaagcagttatccaggcactgaagataaaacagtgaaccagtctgaataaatcactgcccttgtgtagcttacattttagtgacaagaaccacatagcaggctagataacatcagggaacataaatgctagcaaggtaaaaaaaaaaattaggataataaaatacagagttgtagcagtgagatgtgctagaagtggggtaagaaactacttctatgtggaaatgacgttagtccaagtcctaaatgatgacaagaagaatcagatattgagaaagtgtgctatatgaggaggacactgcaagtacaaatttcctggggttaaaatgaacttagcatatcaaacgggcagaaaggaagccaaaggagctttctgaacagtgaagagaaaagtggctcatgcctgtaatatcagcatttggggaggcccacattccgggatgatggcttgagccaggagtttgagtccagcctgggcaacataatgagatcccatccctgcttaaaaaaaaaaaaaaaaaaggacaaagacaaagaaaaaggcaggcatggtgcacacctgtagttccagctactggggaggctgaggtgggaggattgctggagtccaggagcttaagctagcagtgagctatgattatgccattgcacttcagcctgggtgacagagtaagacagtctcaagaaaagaaaaaaaagagagataagtaagagaatttggagaggttttggataccatgctaattaaggagtctagatttaattttaatgcgaaggaaagccactgggaggttttaggtaggagaatgtggtaatccaacaaatgctttaaagattatctgaaagctgcatggataattgattgtgctttgggagcagcagaaacaggatgactacttatgtccaccttagtagctcaggcaagagatgatggctgagattgggctgatggctgtggaaatggtgtgaaatgctcaaattttggttgctgaatgtgctttctaaggtctctctatatgcgtacttgttgttttccattttacctatcagaatttatattttttgagcactaggactttgctttggtcatttttccatgccacaatcgctagaacagtgcctgacacacagtaggtgctaaataaataaacatttgttgaattaaagaatgaatagcttgcatgtggatgctgagataaactcttaaatttggtgcttgagcactttcattgacagtgtgtcatcaactgagatgggaaagactaaaaaaggcacaagtttgtgaataaaaagcaagagttccacttttggcatgttcgatttgagacgtctcttgagagcagacacttctatacacatgtctggagctcagggcctgatatttttttcattcattcatgttttgtttccctatttgctgtgaaagcttggcaagaccagggtctccttaagtgtaccccccagacaagtgatatcaacataacctgcaacttgttagagatgcaatgttttgggctccacctcagaccaactgtatcagaaactctaggctgcggggcgtggtggctcacacctgtaatcccggcactttgggaggctgaggcaagtggatcacctgaggtcaggagtttgaggccagcctgacaaatatggtgaaaccctgtcctctactaaaaaatacaaaaattagctgggtatggtggcatgcgactgtagtcccagctactcgggaggctgagacagaagaattgcttgaacccaggaggcggaggttgcagtgagccgagatcatgccattgtactctagcctgggtgacacagcaagactcagtctcaaaaaaaaaaaaaaaagaaagaaagaaaaagaaacaccaggagatgagttcagcattctgcatttaaccagacctgttcatgactctgatgtgcatcaaggtttaggaaccactggtctaaaacactgccagacatagccataagaaagagctgaacatgatttggggcagctatgcaaagtagcaagccgttctgattgttttttcttgcctctcatcaaatctctctttatcatttgaactttcttagctgctttactttgtccttagaatcaaatattttctcttcttttaaattatgtaactatggttaacagcagaactttaaaaaaaattagcctttccaaacactttctcatctgtcacttaattttagcttctgagagctatgaaacagtagggatgggaattctagccccacttcacatacaaatatatgtaggcaaaatcccattaggtgatttattgatgatcacataaatttaggtagatttgagacataaaaaacattgacctcaagctttactcttaacactgatactaccgagtaaacagtaggtgctcaatacatatttaatgactaagtgaatgattcctcaaatagatgctgcaggattcaagaaaatgcaaatttactttatcatgtatgtacgcgtggaaaccagaatactacgtgaccccgaccttttctttaattggacacccacttccaagctctacccatattatccagcaatatgggaattttatgagggaggcagattataacctaaagttatgaataatcagtttcttatatctttaagacaataattgatatagtgtgctctaattcttaatgtggctacacttctcattctgtcaattacttgtgcatttgaaaacagaggtcagtgttccatgtcctgacctctgttttgaattacttgaagaaggcaaaaaactggtgatgctgagactgattcttgccaatgttatctgtctctctttattttaaaacttaaatcgcttccctacccctactggaatgcttttagcctatcgtacccatgataataatgaaacattcctacatttgcataaagctgtctcatttagcttagcttagacacagattttaaaaaacccagtagacattgaaacatagctagaatacggaaacattaatgatgtcaataataataataatagaaaacattttttgaatgttcactatgttccaaccactgggatgctggatgtggatggtaacatttacccgggatgtgaaggacttactatttttcgtatttcacagatggtcaagctatagctcagagagtttaaatacttttcacgtcatactgatagttcatagtgaagctgtgatttgaatccaggactgtcagactccaaaacccatggcattcaccacttttccacttcaagactgtcagcctccaaaatttatggtatgaactactttcccactcctacctcattaaaacaattagcattacatccgtgaatgcctgtcatctgtgttaacaactcaggcaatgagaagactggcctagttcatgtggtcaaatacagtgggtctattttaattatactcatgctccattgggtcacatggacataaatacatctggttagagtttttttgtttatgccttcaattacctggtttaaagcctagtcacaaacatgctccagctctttcattatggtggttggccatctcaagtttttacaccatttaatcctacctccaatctttgtttttcaccagcttctccagtccctttctgccattggctactggttgtatgctggaactcttgttattacagaaaaaaacacattttcagcttctattgcatagcaggcctattttgagcatgatggatacagcaatgaagaaaagcattaccttttctaaagtgccttacggtcaggtggggacgagagacatgtaaacaaataaggcattcagtttttccatattttagcctcagctctttgcaacttgtcttggctgtcaccctgggtgtcagctgcgcaggttctttccaacaaaagaaactcctgcttctccttctatcaaagggaacactatcctgctgattgaaagtttggcaaagcgcccaagactgtgtgtgtgtgtgtgtgtgtgtgtgtgtgtgtgtgcacgtgcgcttatgtgcattgtgcaatgtctaaacactcaaacaggatatttggaacagaactgtgtgattgtttcttatcagacctctttataagtgaccaatttaaagctgaagatgcattaaaacacaggcttcaggtgatcatctgtaatttaaacggagaaggtgagatggtcaggaatttagttctgagagttttgaccttatcatcaatagaaatgagcgtttatggtctttctatttaggaaagagtctctggctttaagcggctatgccttactgtgctttcataaaaggtcaatttgaaacattctgggcttttaatgtaccaatgaattacgggcaaaagcctttatcctaaaactattagataaaaattatatctttagttttgggataatatgaagaggcaaagccttcttcaggggactatacatagctatttataagtattcgtgattgctgtattgcacagtactgttaatttaaggcaaacatttttgcgttgtttaggatttttgaatgacatgcccatgacgtagtttgcgagaaagggaaaacacttggatgtagggcttgagatgaacttcggactcttccagcggccaagtgtaaatgttaggccacatgagcataaacacatctggctggaacttttcttaatgccttcaattacctggctttaagactagtcacaaacatgcaccagttctgatgtccatagtagacagagcttatctactagggtacattattttgctgaatccagagatagtctcagaatccttctcagcacagtgcttcagacattcactgatgatgtaggtaagtgggcccatgagatggaatatttttgtcattccaactataattcaaactcttttcgtttacagaggacaagactgatattcctaatggtgatgtgacttatttaagatcaaacagataagcagtcaagttgtcactacagccaaggatacacactgcttctacttcttggcccaagtgctttgaaaaagggaatcattttaggcaaggagacgttttctgactgagttgtcagctcttcttttcagctaaacatttatattaagagatttccattggcagagccccttctcacccccatgatgatcctagaatttaacagccggttttggagttcactgtgtctaatattgtctgctcttatttttgcagaggctattctatttccatagaaggcttgattataaaatcacacagtatagaaaatagttgtgtaaaaaaccttcaacagaaacactgaagggactctggctttaaatcaatgcttggctttaaatagggaagcaaatatcattgcgtaaaaaagataactaaaatatgactcattgctgggagaaaaggggatacttttgagaaaagatttctttaagattatgtcttacagagctgcttacacatcatacagagtattagaatggtttcattactacaagttaagagtcagattagaataatcattaaaagggaattccctgtattaaaaccaccaccttccactgaatcaattacactcctgtgtcatgaacatcaccaagaatcctagattcaacacagcattgaaagctggcatgaagattatttattaaccttagcattatcccaatttgacttgtcttactaatttttgtttcatccagtctcactaatggtcaccccattctcccagtcactatacccagaaacccaaatattatgttcgacttctttcattctctccctcatacacctaatctattaagtcctattggctctacgtctacaatacaagctagtgccatcaacctcttcccatcttcattattcccccaccctagttaatgctactgtcacttctccccagactataaaataaattacagaatgacagccctgcttctcctctttccttccactccaatttacacttctcatggtggttagactgattttcctacaacctgaatcagataatgtcactccaatgcctgaaattttcaaatagcaactgactgcaatctgaatcaatacaaactcctttagatagcttacaaatttctggaccctgcacatttccccagtcttatctcataatgttcttctgttcactcaccatgctcccaacagatacatcctttcaatattttaaacgcatgctctttcctatcgcaatgacttcccataaacagttcctttttatttattttttttgaaaacctttttcccctttctacacaagagtggatcctgctcatctttcaggtcttggttttgatgtcatctcatcagataccacccctccacaccccatagcagatgctttcaatactctgctcatatcaccttgggttgccctcttatcttcctgaacatgaatattcactcccaactgccagcatctgtgtctctttgttggaggatgaccttcaggcttccagaatgcctttgactgtacatggagagcctgaagtggctgtggatttgtatcccgcttcaccccagagtgcagccttagccaatgactgatggatgaggagtataaatgctccagcttcctggcttcatgatggatttagctctgcaattgaaatgtacttcccttacatcttccctgcaggattgagccagttatcctctgaggatctttgcttgatattgtgttcttatttattctccttccctttctggacctattttttacttccctaccacttctctgggagcaatttctaataaatcacattgacacaaaatctcatctcaggatctgcttctgcaaaagcacgctaagagacaactccaacttttactcaattactctccatcagtgaatcccatttattttattccaagcatttatcaaaaactgttgttatatattgaatttcttgttcacttgtctatatctctcattcaactgtgaacaaactgaggacatggactgtatccttttaaaactagtatacctccagcacctagcacactgtttggacatagtagttgcctaactaatgtttatttttaagagtgaatgaataaataacaaaatccttcctggtccccctgttcatccaggctgaattccttcttcctgctctggtttccatgatgtccatcaagtagcttctgatcagaattcaggttttcatggagcttgactataagggtagcatatcttggtcacactgacatgagtaattggtccatatgataattctccttgttgtaatatgccgttctcctttgagaatacactatatgccaggcagcactaaggtagagacacaatattttattaaatcctagcaaacagctttgtgaggaagatacattacctttgtttttcagaagagaaaactaatattcagagctaaggaatgtgcccaaggtcatccaaatggttagtggcgaaggctgtattagaatccaagagtgactgcaaacccgtgttcttaaccttcatcatgccacctctgttctatgtgaagtttacttagcttcttgagccattctcttgggaataattaagttaaaagactaagcttctgggccttcaaagtagagggccaaatcctagaatgttatgacttatttgagccactactcagctccagctggccttgaccttcaaatcggcaccaccactttctgttcctgccagagccggtgctctaagacaacttgtataactctaaatgtatagccaactttctgtttaattttttaattttattttttgcgacagggtctcactgtgtcatgcaggctagagtgatcgtagctcactatggactccaactcctggctcaagtgatcctcaccctcagccccctgagcttctgggactagaggcatgcaccaccatgcctgactaattaaattttttttctttttttggtagagatgagatttcactgtgttttccaagctggtctggaattcctggccttaagcaccttagactcccaaagtgctgggattacaggtgtgagccaccatgcccagcccaatatatatatacgtgtgtgtgtgtgtgtgtgtgtgtatccttatctgtggtagacattggctatatagccatccaaatcgttagtggtgaaggctctattgaatccaagtctgactgcaaagctcatgttcttaaacctcatcatgcagcctctgtcctatgtgaagtttgcttagcaaactctacacatcccaatttctaccacagagaatggaggctaaagagttgttctgatattcagcaatctacaaataaattttcagctgatggtcaaaagagacaacagtctggaaaacatgaaaagccaaaggaatgacttaggaatagaaataattcactaatttattcaattaatgatatttatccaacatctagatatgccaagtatgcacttgatacaagaaagacaaagcaaaatgagaatcagaaagggtccttacaacactggcatggagatgattagcatggtggttaggaacgtgatgtagaggctgagagttcatgtttagacaactcactgctgaactggaatgcaggctctgtctcttccttactggctgtgttatttaatctgtgccacatttattcctgtgtaaaatgaggatgaaaatactacacccaccatgctcatcaaggtgtcctaaagattaaatgacttaatgtttataaagtttttggagcagtctctgacacatatgatagccatgtaagtttgttcaataaacaaagcagagattggagctaaaataaaataaatgaaagatattatggggatgcagaaaagagaaacttagcctggcgagaaggtgcaaaaaccagaaaaggatcacaaagatgtaacatttaaagcgggtcttaaggccaggcacagtggctcacacctgtaatcccagcagtttgggaggctgaggcaggtagatcactttaggtcaggtgttcgagaccagcctggccaacatggtgaaactcccatctctactaaaaataaaacacttagccaggcgtggtgacttgcgcctgtgatcccggcaactcgggaggctgaggcacaagaattgcttgaatccaaaaggtgaacattgcagtgagccgagatcataccactgcattccagcctgagtgacagagcgagactctgcctcaaataataataataataataataacaacaataataataacgtgagtcctaaaagatggtttggaattcaccaatgaaagaagtgagaggaaaaaaaagagggagacaggccccagcaccagcacaggcaaaagcaggcaggagggaagctactggttgtttacctgaatgtgtttgcataagaagtgagaggatggggagtgatgagatattaggttattgcttaaaaggaattaggacattaagggccttgggaagcaataaagaagtttgacttcatgttatctagaagtaactttaagaaaattttaagtaaaaataatttcacgatcggagttacaaactacaaagtccactctggccacagtatggaagatggcttttgttgagtgaagtcatccacttaccgagttgccagattaagccaggtaagaatgacaggagccttaaataatgaactatcactggaaagtatatttataggaaataatagcaacagacaagccaattttgttttcaatggtcaaattagcagtagttcattttgaataaagttattgacctctgaggcaaagagatagaatcataatggaaaataagttccacaatcagaagtcagcactccaaattaaaagccagtcttcacctatttgatgggtggaaggacacttaaacaatcactgtttgtttctgacttttgaacacatcaaagaaagcatcaatttttatgttacctgagacactgaagaaacaattacatatttaaaagggctaaggaactttgcaaagtgtctataaacaaggtaattattcagaattaattcagtaagaccataataatgattgttacaatttcttgagcacttgctcatttccattgtgctagcaatttacatatattatctcatttatattattatctcacaataattcaataaggtaggtactatcagtcccatttaacagatgaaaaatgggggtttaaagagatttagatactcacttaaatgtcaagaggtagagcagaaaacccaagtctttccacatgtacagagcccacactgataacatctgtggtatcagttctcactgtgaatttatttgaactcagacattctttttaaggaaataaaaatgcaactttacgaagcgtacaatggagagtaaagaggatgcttttcctattatagtcatttttgcacaaattatccttctcacttttcatatactaatgatgttttcactgaggctgagcatttgactaaagtaacaaattattccttaaaaacaaaatgccaaggaaacaaaaaaaaacatgaaaatacattgaggacaactcagactgtcaatttgatagcagttacctgttaacagaaagggttatactatagtgatgacaacttggattccctggatttagccagaatggaatgtgactctcagctctattatttacaaactgggcaaaaacttatggctaaagctaagaagtaaaaaatgaggacgtttgacctaggctaaagtgcatgtggggtgtatctattaggcagaaggagctgcatctgcgaatgtcccaagtacaggtagatcttgtcttaattataaacctacaagtacttcagcatagctggaaaataaagcacacaagatggtgtgtcaagaggttaaaccagaacaatggcagaggccttggacaccatggtaaggagcctgcccatggttttataggggagagtgatgcaatcataatttggctatagtgaggaagaaggactggaaagctactagaaaggtaaggaaacatcttaagacattgccttaacgatccaagtgaaacgtggttagctaaggtcttgggctagtcacgtagtctatgtctcagtttccttatctgtaaaatgagatgacagctgctataatgtaggttatgtgtgagattgaatgagatgatatggtcaaagtgcccagctcagctatgaccactgtaaatagaacgatgtgatgcttgatgaacacaatggatgctgactcaagtttatatttctttcaaatatgactgactcaaaaatgtcatgttgttaaaatttgtccagctagaagaatattcatagtgacagtcctctactgtttaatgtgtattttaattgaatttgtttcttattgaagagtgcattaagctgccttttaattctctcatgacaataataccatggtgttatgtttgactaacctcgggtcctgcatgaataaaggtagattaaaaaaaaaaaaactcttctgacactatgttgaataggagtggtgggagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagcgttgttgaattttgtcaaaggccttttctgcatctgttgagataatcatgtggtttttgtctttggttctgtttatatgctggattacatttattgatttgcgtatattgaaccagccttgcatcccagggatgaagcccacttgatcgtggtggataagctttttgatgtgctgctggattcggtttgccagtattttattgaggatttttgcatcaatgttcatcaaggatattggtctaaaattctcttttttggttgtgtctctgcccggctttggtatcaagatgatgctggcctcataaaatgagttagggaggattccctctttttctattgattggaatagtttcagaaggaatggtaccagttcctccttgtacctctggtagaattcagctgtgaatccatctggtcctggactctttttggttggtatgctattgattattgccacaatatcagatcctgttattggtctattcagagattcaacttcttcctggggagttattcttatactttctatcctgtgtacaatataacaaccccacagctaaattttacaacattataaaaggtcacttttaatgatttaggcctttcatgtatcaatctttctacattaacattttctggaatttcaacatcagagttttcttaaactaagtgaataaatattcaagtctctgtgtattttgaaatgactctttgcataataatgtttttatatgaaaatggagtctctgggtgcacataaacaggttttactgatcttttaatggaaccaactgaagcacagaggcctttaatatcaaacacagtgctctcaatgtttataaatatttgtatagggatgccacttcccgttttaatattttgttactttaacaccagtaccactgtttcctctcattaattagctattgatgttttctaaaattaactttgcagacagtgttcactgacagagttctaaactaatgagtctgactttgtcttgagggaggcagaggaggggaggtggtcacagacatgcaaggagacagtgttgctttctgcttcaacacttcaaggggcagaggaacatttcttttacatgtggcctttgagcctgtgaggcatttgagcaaggaacacctcattcaccaatattttccaaacacattttaaaacccatgtgctaagggttttgatagagatggtattgggtgctatgggaagacacccaagacccacctagtccagtcctggcaacggtcaagaaaacttcctgggcaaaactatggctaaagccaagacgtaaagaatgaggatgtttgacctaggctaaggtgcatgtggggtgtgtctatcaggcaggaggagctacatctgcaaatgtcccaagtacaggtagatcttgtcttaattataaacctacaagtacttcagcatagctgaaaaataaagcacacaagatggtatgtcaaggggttaagccagaacagtggaagaggccttgtataccatggtaaggagcctgcccatggttttatagaggagagtgatataatcacaatttggctatagtgagaaagaaggactggaaagctactaaaaaggtgagaaaacatcttgagaggtttccttaatgatccaagtgaaacatggtttgctaatgatagaagagacagagaagatgtattgagacaaagtaaattaggatatctaatagacagagtttgcctattgactagacatcataagtaagtgtgatgcggactatagctgcccaggtaaatccaaggagtctgtctctatgtttttcactgactccttaatttccagcttgttttatttatttttatttatttatttggggggacagggtctcagtccaatgtccaggttggagtgcagtggtgtgatcatggctcactgcagcctcaacctcctgggctccagcaatcttcccacctcggcctcccaagtagctgggcctacaggtgcatgccaccatgcccagctaatttttgtatgttttgtagcatcatgttgcccaggctgatctccaactcctgagctcaagcaatcctcccacctcagcctcttaaagtgctgggattttaggcatgagccactgcgcccgccccagcttcattttagagtgctgggtgaatactgccacatctcgataacctaaattagaaatttacaggaagagaagaaatacatggctcaaaagttggggggaagaaaaggatggcagctgcatagaaagaacagggactcaagagatcagagctcaaattgggcaggcacaattctcattacctgtatgattttaagaattggttttggttttggatgtgagctaaaaagaaagacagtttggcgaaagatcctaaactatatctacattagttcttccctgttactcttcaaatttagagcaaagcccatttgaatttattgggttgagtacttaactcaataagcaaatcaggtattttgggataagagcatgagtgggagcatttcatactctaggtaaacagtttaaccaccggggagtatcataggctcaaagacttttcaggctctgacggtgttaagcaatacctagcacaatggttcccaaccatttctagtcatggactctgttggtcaaattaacacttacacggaaatccagaatgccaaatataaaaagggatgaaagtggagctgctttggttaaggaaggtatgaggtaccagccattgggcctaccctcagctgccaaggaaaacaattctgcagaacccagaagtattgctaatgtgcagacatacactcagactcgaggagtgctgctgagggttggtaggtagtaacgtaaacgtgttaagatgatagaacacctaaaaccatgctactgattgtaaaacagttcaaaatactattagatttaattcatcaaatagatcaaggtcaactttaactgtagaaaataagagttattatgcacatgataattatgtatgaagaaatacaaagccaccaaaatataatctgccacctttttctggtttctccattaataaatatttgctattagctcattcaattaatttttttccagcacttggaagaagacacattaatttaagaatagattgtacccaggtgcggtggctcacacctgtaatcccagcacattgggaggccaaggagggcagatcacttgaggccaggagttcaagaccagcctggccaacaaggtgaaaacccgtctctactaaaaattcaaaaattagccaggaatgtggtgtgcacctatagttacagctattcagggggctgaggcaggagaattgcttgaacctgggaagcagaagtagcagtgagctgagatcacaccattgtactccagcctggtcaacagatcaagtccctgtccccaaaaaaaaaaaaaaaaaagattgtaaaagaaaattctaaattataaaagctctatccacttattttttccttgtgaaacaggaagtgtttgcattattgaatttagggtaaagagaaggatcttggtctaacctgaaatactggtactttccaataatacagtttgggaaccagagttttaatctagtcatatgatttttaacacacgaaatctgaggcattcaggggtccctctgtaaggtcattaaccaaaccaaagtttattgatttatttttctgtaacagtgtctgacaggttatggtcagagactttccatgtggaatggagacaatcaggtagaaaagatttgcttttcatttctagtactgagctttcagtctagacaaagtaaagactgttggtggtcagtaaaaaggactttcttatgctgtgaaatatagcattttaggagatgcagcattactcgtgcaactgtgttcatctgctttattaacatgtgttatttatgatgctcagggtgccaatgcttatagatagttcttggaaacaattttactaatgttgtccaaaggtctgatggggtccaaaaaaaagaggcctctgggggactgcctgtcacagggtaggggagaggatataaagatgggagaggtcttggcttcataatcacccccaggtgctttggggctacacttccagaagcttgggatcaatgggagaaataaaatccttccgtaaataatgcagtgtgtttctataaggctcgcacacacataagaaggaaaagggacaggaactattggttgaaacaggaaaggaaagtaattatctgctggtttggcagtgatttatcgagaatgggaaagcaaatcattaccaatcaagaaagctcttaggatagggcaaggcagagaggtaaaactattagatgcattcagaaagaatttatgtgctttcttcatcagcaaccccatacattttactgtatttttaaaaaattgtcattacttagaaactgtgaaatatgaagaatgccttcttagtcaagtagcatttttatttgaggtgaactgcattgctagcagtttatttcgtgcagttttatagtggtcaggcacatggactcaaagctggactgctgggttccattcatagctaggtattttttggacattttccttaacctctctgccttcgtttcatcatacataattcaggataatagcagtaccgaccccataaagttgttgggaagtgtaaatgaattattgtatgaaaagctctgggaatattacctagcacattacaaatgctatattagagttggctattattatttattcatatataaaaacaacactaaattataataatagctcatgtttattgagtgcttactgtgagtcatatattttcccaagcattttatatgcaagtcagtcatcagatcttcatggcaaactattagatagagttattattatccccattttacggataaggaaattggcagcaaaactcaggcctggagctctttattactatcccttcatctctttaatatgaatttccttttccagtcttttcacatagtttccttcttcgtgtagagaaattaacaaaatgaatgtactttgaaggaggctaatccaagtaaagaagacttaagacaagctatgcctgtttaattcagctcaacaattcacaccttcataagccatgacaccattctcactgtatttcattttaatgctattattttgcttggtgactggtacatataaatattttatacagactcttctctttgtgccattaggatgatgaaatgtatatatgctaatggaattctaaggttctctgatttttcttttagggtcaattgtcaattatctacagcacaattattgtaagttgaagcaattctttcttccacttttctctatcagtatcgtctttgttgagatgaagcattttagtggcaatagacttactcataacatagctagaattgcagtgtctcattttattgtgtcactgccaaggatgatactggcagattcttaaggtactgctttgttgacaatgtagttgacactatttattgttattcttaattattactgatagtacatcaaaagtggaaaaggacaattgaataaacatatccttatcaatttgacctcttctaagaaatacatgatccccttgacttaacacaattcctggtcaatataagtgtctgccccactacacccccattacctgcctaatcagacctacctactgtatcctctatagcaatttcttcctaattgttgactgttctaatggacagtatgttcggaggaggcaacatggagcaatggagaaattgctgctgagttatctcccacagaaagtctgacttccctcctgtattatcctatctcagtgaaagccatttacattcaagtaggcactcaagccaggatctgagagtcatcttttaacagtgacagtgagaaatgatgactagtaaaggaatcgggggagagtggcttgactcactccataatcctcatcattatactctttccatgatcgttttactttccatacctttattcataacatttcctcaattctatgtagaatgctattttaacatatttaatacagtgtaatatccttatctctccaaattgcagagcttctaaattccacttacactaaaacctgaagctgctgcaattcttccaactttttctcttactatacccaaatcccatgaaaggtgatgaaaggtggatcactcgtttctatatactacagctgtacctcatatacacttctattattgcactttccacacttcatgtatgcatgcacgtgtgtatgtacatatggaaggtgtgtgtctccatttgactggagctctccaagggccaggtcttattcatatctaaatttgaaatacgcaacacaattcctagtatgcagcaggacaggtgtgcttattaaattattgcagaataaacagatgatggataaaagaatgattagactaagggtctgcttgcaggtctcatatgaccttggaaaaaatcaggtaatttctcactgcttaagtttgttctttcattaaaaatacaaattattttaaagacttataataatacatgttctatgaaacagatgctcctgtgaacaacaaactaggatacacttgtaaacccttccacttgctgtgaagtaccatgcctgtgtgtgagaattaaaaattgtggatccaatcaaagaagtataaggacagaaaaactatccttgaatatgttttcaagatgtgtactgtttgaaactatatctcaggtaacaatcaacagttttaagaaagagctttagaaatccaatcacaaagaaaagaatctttatttctccctttgggatatgacatttaacaaattaatttagaattctttaaaaccaacggagctaagaggaaattgagaacacttgtactaatcactcccaacttaaatgtagaaggtcatatatctaaaaggttacattactacaatggagaaattcaattactacggactcctaaagggctttacttaaaatagcacagaactgtaatgctgtcaattccaatgaaaataattgcatttccctaaatactgtgaataatttggtaaatacatctattctcttaaagtacaaatttccaacatctgcagaactcaagagcccaaaacataaatattcaaatatttcatcgagagttttaaatttattaataccaccaagtttactcagctgtttctatacttggatgactgatttttgtctgaagtttagtaaagaggagggtatcttgcttcaaactcactatgaagattgttaatttgattttttttcttcttttaacaaacaattcttttaggaatttcttaaaaattaaatgtgacaatctaggtccatagaatgttaaaatttaaaagaaattgatcctctaatcccatggcactcaaacctaaagccattactcaaatatagctaattctgggccctggtgttaatattcagatcctgttggtcagaattgggtacatttgataggaaccatcattggttctgatatgctgattcatggatctgcatagttatctatagatttctaattcagccttttatctttagagatgaagacgttgagatcctgacagcaaaaataatttctgaaagaccctctggactcttacagctgtgattcaaaacccaggtctcctgacttccagtggagtgctcctttataccatgagacatcctggaaggtcacacacctgggcatcagtgttcagagtacactgttatgagcccatgctgaatgcctctagccacatgagatcacatggattaataggtctataaaacaggaaacctcaatgcgagcaactcagcctagcaaagcagaatgaacaaatgggcactcaaatcatgcaagtgtttacacttctaattatgaaaattgttaacagagcttccctttattaattctcaccacaggccaggtctaaataaaatcaggcaatcctcccaacactcctatgagaaagcctagtgcaattcttattttatacagataaggaggactctgagcaaggaaatctagcataacaataaatagtagatggctgggacaaaagtcaaactcagttctctttgctattttcaccattccccttgtcctttccttcctgttgtagggaaataagatacttcaaggtttagcatttttgtatgaacgttgtagaattccaattgcggaggctttgccttcatgcatgagggtcaagcagtactttactatgagatagaccaagggtgtccaatcttttggcttccctggaccacaatggaaaaagaagaattgtcttgggccagacataaaatacactaacagtaatgatagctgatgagttataaaagaattgcaaaaaaaaactcatgatgctttaataaagtttacacatttgtgttggggccacagtcaaaaccattctgggctacatgtggcctgcaggcagcaggttggacaaacttgatatagaacttcctcaagcaaatggtgccactacattctgtccaaccgggtaacaaaataccctaggaaaatagtagcttttattcacaacacacaaccaggcgccaccttaatccacagtgcctgtgaatgtgaccgtttaaattaaaatgcagtcacaaccctgctgacaccttggttccagacttctagcctccagaactgtgagacaatacatttctgtggtttaagccaccctgtttgtggtagtttgtttcagtagtcctagtaaactgagattttctctttttttttttttttttttgggtagatacagtgtttcaccatgttggccaggctggtctcgaacgcttgacttcaagtagtgatccacctgcctcagcctcccaaagtgctgggatcacaggcgtgagccaccgcacccagtcttttcatgtctttaggtcagattcctcatcattggattctgagatggtaatagtgctgacaagtgctttgagtttgaagttgttcaacttgaccctggtctatgtgtcttacctattttgtttcatgttgcaagcactgctagctttcctattcaatacccatcctcccttctttttttctaatagaaagctacttttgtttgtaatgacagtggcccatctataaacttcaacttcccagactcccttgcaactagaaatgattttatgatatagttttgggccaatgaggtgtaaacagaggtctgctaaggagctctgagaatttttgtttgtccgtttactcatcaattcattcctttattttaatatcagtgtcattccttctttcttcactatttattctccatcctgtctggaacatgaatatgaggttagagttgcagcaacaatgttgagactatggatgataagtgtgataaaagccatatgctaagcacggtgtgaagtcaagatataactctgtcaggacttcagcctttttattgagaggaaaaatatacatatagttaagcaactaaagtaagatttttgtgttcatatagccgtattcaattccaactggcaaataataggaaatcagctgtggccccagagaaaagatccacagataggaacttttcaggctcttctgatgaaaatgactagatttttcaactcatcagcctacagtgaaagtcaccaataaacaaggtctgctcagtcatacagaatgcaatcagcatattattatctcactctgaaatattcatagagagccaaggatggaaaagcagagatcaaaacaaatagtataaggaattcagaggctacagattcagtgcaggaaacaaacaaaaataaattttaaaaatatatttgataccctagggtaacatttttaaaagggtcacataaatggaacaagaataagtagccattgtataataaaagaggaaaacacagtaataaacaactctcataaattcaaagaaaattgttagcagatataaaaaggagttcattaaggaagagtaaaaataaatttaagagaatctcacataaagaaatacgttttagaagtgctgcaaagtcagaggtaaacaattagaaaattgcaatagcaattcaagagactcaatatctgactaacagaatttacagaaagacaaagcagaatcaataaaagagaaacacatttcaaggaaataaagcaaaataattcgccagagttgaagcattaggccgtcagattcaaagggcctatcaaaggcacaaaacagtgaaagaaaagaaatccatactgaggcacatttttctgaattttacagcacctggataaagataaaatgctaaacagcttccagacagaaaaaataaaataggttagatgaaaagaatggcgttctgcttttaaacaagatatgagaatatgaaaaagtaaagctttaaaaaatcggaagaaaactgttctcctaaattccaatataaattataggtcatgtgtgatgagatttttttttaattgagagtgaaaatctttgtaaaaaattcccactttctttcttgggaagtaatggaagacacacttcactaatgagagagcagcaaatcagaagaggatgtggaatgtaacccaagaaagaggtaaagataattctttgttaacttttattttaagttcaggggcacatgtgcaggtttgtcatataggtaaactcatgtcacaggagtttgttgcacagatttttactcaggaattaagcgtagtacccaatagttatttgttctgctcctctccctcctcccaccctccaccctccagtaggccccagtgtctattgttcccctctctgtgtccatgagttctcatcacttagcatctatttataagtgagaacatgtggtaattgttcctgaattagtatgctaaggataatggcctccagctccatccaggttgccacaaaagacattatctccttcttttttatggctgcatagtattccatgatgtatatgtaaaatagcagagacatggaatcaacttaaatgcccatcagtgacagattggataaagaaaatgtagtacatatacaccatgaaatactatgcagcaaagagagttctaagtgagcctgaggagacctagagaacagctgccaatggcaacaagaggaaagtgttaaggagagatgtccccaagggcagaggggagatggggaattacagtttgagattaaaattgaaattggcaaattatacatatacagaaactttggcaaatgaaaacaaaaagatgccatttttactctaaggaaaacaaggtagtaaatgcaatcgtatgctatctagaagaggtgggaatagtattacatgactgtaataatgcaagcccttgaatgttgagtgaaaacatcaggaggttggtgataagggagaatgtgtatagagataaaggggtgttgttagagaggataatcctcatgttccatatgtggaagacaggtaatacctgaaatggaaaactcaaggacgatgagtaagaacagatgtattatgaaagcttatattaggttggtggaaacgtaatatggcttgccattacttttaatggcaaaaaccacaactacttattttgcatcaacgtaatggtagaacaaacagtcaaaagtttcaaggaaattgcatctatgaagcagaattcagagttagggtagggtggcacaagttgctgcttttctggttttcttcttgtgtatttttctgttataggtgaagggtcacaagctttaaggtacaatttcattttcttttttaaaagttcatgtagtactttaattaaagtcaatattaaataaaaatatttggctttggatttactttttgaaaactgagttttggtattggcctattgtttcaccatacagaactttaaagattatatatatatatatacatacatacatatacacacacacacatatatatatgccctacacatccatagtagtaaaaacctagaaacaagagctaatattaaatatattaatattaataatttaatatcaattaaattattcatcaaatattaattcagccagcttctagtctaggcactggtgatacatcagtggacacagtagatggacctccctgttgataacaagtgtatattttgggtgtgttcagatagaatatccttggctaagtcacgtactataatctatttgagccctggcttcctcttctgtaaaatgggcatacaattaaccactcattatttcaaaaattaattatgaggacctgttcagcttaaaatttttttccatgttaagatacaacatctcacaaagcagcactttactattaaaagagttcatttcgccatcattcctagcactagcaaattgaactattagggatgagacctccaatattacactactgccacattcctctttattatgaaaaggcagattgccaaaatcagtttctagtcactcagtttgtctaaatattgcagggctttttgatgttgcattagcagaatatacagtctacatttattccattcttttgtcggcctatgcaaaaaaatgaaatgaatctattcaaaatcaagatgcactgaactgcatatgatgcaaaagaaggattttgctaaacacagcaactatgtaatgcaccccattccttccccatcagcttggatcctgagactattttgtaaatctgcagagataagagttttctatatttattgaaaggtcaaaagtttgggaggtggagaggtgtaaggcaggtaggaatacagtattgtatttattaaacaatatgtcagaaacagacacatagcaggcactttgtaaagtacaatagaaaacaagcacctgttatctctaccactctaatttgcaccatcatttctagtaacagcaaaagcctccaaagtggttttcatacttctacctttcccattcccccatgaagacatccattagaatgatccactgaaaatataaaccatatcataacacttttctctccaaactttcattattttccccaaaagtccaaattttcttcaataacctacagaaagtatttgttaaatgaaagaatcaacccatctagcaaccaccagtgagacttgggtcactagatccttgcaatgtgttaagtaatacaattgaaataaaaagcaattagaacactggaaaacctactattctatggtatcactacatggtagtactgggaactaggacatgtgttgtgagtaaggactggaagttaagagaagtttatgtgggccatagtggtttgggtttcttgcgtagcagagactcaagtgtgagttggagatgtgaatgctccagtcattatgttgttatttaattaaatacaagaaagaaaagaacccatacacctgtatatctcaagtccacagctatcacgtcctcaattctataagatacgctttatcctctctataatagtttaaatgatctatttttaacaaaaaaagttacattttcttctttttttttttttttttgagatggagtcttgttctgttccccaggcaggagtgcagtggcgcgatcttggctcaccacaacatccacctcctgggttcaagcaactctccttcctcagcctcccaagtagctgggactacaggcacgcaccaccacgcccagctaatttttgtattttttagtagcaatggggtttcaccatattagccaggttggccttgaactcctgacctcaggtgatccacccacctcagcctcccagagtgctggaattacaggtgtgagtcaccgcacccagccaaaaaacagctactcctatggatgcagtaacactgcactggaatagacagatacataggtgacatacatggactgaaataaaatctgattgatgtgtcaagtttagagcagtgacagactcactgtgaagatggtagagaaacttgaactccagtaaactctgttatctggaatccaataaattgcaaagtgattaagtggtctctttgcacttaggtacacacctaactgatattctaagtagtctttgagaccctgaatttacacaactcaaggagagattaaattgtgtgcagcatcatgagagtgttgggtttattttattgcattccaattatttgaaaattgataacctgtgtacatatggcaacttcccattgatctgaatattggattaagtgaaacactctgaaattgccaactgaactgattgcacctaatgagatggagatgtggaaatagccatgagcttttcatcaccggctgcaaacctgcaattttcttggtgaagaaagaaaacacaaaatgctattggaaagtggttttcatgtcttgcacaaccccttcatccataaccttcaattctagatggctgcatactgttcacttggctaacttctagaatagagtggtggattctaggcaacaggatgtgatcactaaaaagacataaaacaattctaaaaatgtgttttgaaaaatatcaggtaagttctcataagtgagacattctcagtttaggtaaagcttagaattgtgtttcccaaatttcagttagtcacgtagctacctgtaattgcactagcaaatctacatttaatttatatgttatttgttatttttcttacgttaattcatttaacttacacttaaatacattattgttaaaggaaatattatatcactaccaaactataagtagatatcttttaccataaagagataactacaaatataaataaaatattgtcttcaaatattagttctgagttcaggactgtgatctctttgccaaaagagaaatatacaagcatttgtgatgtgttaaagactggcaccaaaagatgtgtgagtgtgtgtgtgtgtgtgtgtgtgtgtgtgtgtgtgtaatgctgttaaaatttagttaagcttttaaatacatttttaaaattggtatctttactataaggctacttgaagtctataaaatgctaaaaagtattgttattttctcagacaggtttatgttatccagtgtttcacaatatgtgtagagcatgaaatattttttaggcagaaaatataagaagatgcatatttctctcaatgtgtgctggcaaattgtgctgttgcttttgctgtttttcaaattccttcatgcctctatgatactctttgcttctgctcagtaagttagtcactctttcttaaacatgacacagttttcatctccattcttgactcatagtatttccttcactgctgcctcactttcagcggttaaaatacatctctttgccacccaaatacttgcacacaaaatagccaaaaagtgagaacacccaaatctccgtcaactgctgaatggttaaacacgtggcaaactcatagaagggatactatttagcaataaaagactgaattactcacatgtgctactacatcaatgggtcacaaatgctaagtaaaaaagaaacaacaaaaactagacacaaaaggccccattttctatgaatatatttgtacgaagtatccagaaaaggaaaatctataaagacggaaagtagattagtagttgcctggtgggagtggaggttaactgtaaatgggtaggtgggatcttatttggatgaaagaactgtcctaaaattggttagatatcatgattgtacaacttggtatatttataaaaattgacttttatatttaaaatgggtgaatcttttgaaatatacatttttccttcataaaattatgtaaaaatttcagccagctaggtggacaatcaaccacctatccattgacccattcttccatcttttaacgttttctctctcatgccataatctgaaggtgatttattcttgtcttgagaaaacataccattatgttttcatatatcatagatcttttcatttgtctttcttgtatgatattcaaatatttgtctaatatccttactcgaccataagtttttacagacaaactactctgaactagtccatgtgaaaataaatacttattgaatctatatatacatatgaagcaaattctatttcatggggaggggggaggggggagggatagcattaggagatatacctaatgctagatgacgagttaatgggtgcagcacacaaacatggcacatgtatacatatgtaacaagcctgcaccttgtgcacatgtaccctaaagcttaaagtataataataaaataaataaataaataaatcatgctactataaagacacacacacaaaaaaaataaaaataaaaacaagtaaaaatacccattagcacatattattaaattgcctgctttgaaatctgcaatttactggccgggcacggtggctcacacctgtaatcccagtactttgggaggccgaggtgggcagatcacgaggtcaggagattgagaccatgctggctaacacggtgaaaccccatctctaccaaaaatacaaaaaattagccaggtgtggtggcgggcgcctgtagtcccagctacttgggaggctgaggcaggagaatggtgtgaacccaggaggcagagcttgcagtgagccgagattgcaccactgcactccagcctgggcgacagagcgagactccgtctcaaaaaaaaaaaaaagaaaagaaatctgcaatttactttttgttatctaactttgaaaagtggtttaatgcctcaacacatcagttattaattcaaagaatgataataatagcagcaacaaaaggtataagcaagagcagccgcctttactgaacacttactttgaactggccaagctgtttggtacttctcattttgcagatgtcattccagaaaaaagaagctgagacacaatgaagttaaatcaactgacttaggtcaaatgccttggatgtagagcccaaggcaggatttgtatacacatggcttttgaagggagtgctctcaaggcatggtaggaatgagatgtaggaaggtaaaagaggggaagggataggagctaagatttttcaagggaagttttgctctagtctgatccatggagatctccgaggataaacaggaaagcagagtttttcctgtcttaagacaagagaatggacttaaatatacctgttcctgttactgcgcatgtgggtgcccttgtgtgtgtgtgtgtgtgtgtgtgtgcgtgtgtgtgtgtgtagccttggctgtagttacccaaaagtaatcctgcagaaaatgtaaccgacgtgagcacttgggggtgcccacttctgggggatgaacacacccaccgggagaagggattccaagagacctgagcagaccccaacagcctctgctacagctgttggcccaaatcgcatatatagtaaggggaatatctgagattcaaacttcaatagttctgatgcctatatcagtgcctttaatgccccacctttttcaggcagtgccacatttgatacacacacataaatgtacaatatccccattatggcttaggttgatccattagcaaatattttttaaattaaatattaatgcaaactaggataagaaagtcaagcctatttggcacccttctttaatattttaatgaactgatacaaatattttttaattacatgcattatttaaatagtgtctgaggaacttggaggttgcttgaaaaggtctcccaaaattttaaatattccccactccatatcttatttagactaatatatttaaattcattctgtgaatgaagatttgctcagaacctcagtttgaacagtgtgctaatcaccatatgttccaaatgagtcactctgaatttctgaagaattgttatatatctttagttttcattttatcagagataaaaccataaaggcaagaaaaatttgatgttaggaagcagttgatgagccaactgcctcccaaaggaaaacaatgccatgaaactacaatctataaaacaaacaaggccgggcgtggtggctcatgcctgtaatcccagcatcttgggaggctgaggtgggtggatcatttgaggtcatgagttcgagatcagcctggccaacttggtgaaactccgtctctactaaaaatccaaaaacaaaacaaaaaaaaagccaggcatggtagtaggtgtctgtaatcccagctacttgggaggctgaggcaggagaatcacttgaacccaggaggcagaggttgcactcaaccacgatcataccactgcactccaggctgggtgatacagcgagatcctgtctcaaataaaataaaataaacataaataaacaacacaaaagcatggcttgatgcctgccatctagcactgcacaaggagttaccaactttgttctaaagatagcatgacttattgcaataacacaaacactgtgtataagaaatgagacaaactctaaatggaaattgctcgccagagcactcagagcctttgttcatccattttcatccttctcccaatccagcttctttgccatttacatgtagatacacaggggaatttccatgtcctccacttatcttggttaccgctttttttctccttatctttcctattttgaatgccagcctcacagctatcaactttcaaataagtagccaagaggtctgaatacttggagtaaatagaatgtttgattggacaacattgtgtatgcatttcactgagtaaaatgctagtctggatacctgcctatgataaggccaccgttccctattaatatgaagcaacaattggttgagcaggggagaattaacatggccaaacatgttatatagtagacagcacctctaactggtcacatatttaagccacacaatggcaaatggggaaataaggtatatggctttggggtaaaggcaagtatgaggcagagaccaatccctggaagtattttctttgaaaagggaatccttcagagagtgaggcacctcatttctattttaaactatagccagaaacatttctcctaaatgagaaatttgccctagggattcctgatgtttgtcagaaaccgctgtaaatttattttcattcactggagagaagagaagggaggtaacatttatgacatatgcttgtgcttttcatctgttatttaattttcacaagtttttcaggataaaatagtatccttattttgttgataagagaattgagatttagacaaattaaaaataaaacgaaaagaaaagacaaattatagcatgtaaaccaagggacagatcttgaggtaaaatccagaccttttggacctgatgttcatgttctttccattcttccatgcaccctagggcttaatacatcaactcggaaatgtaattgagaggaggctacaaggagacaccattgtttgggattaaacaaaagcaggctgttttgtttactgtaagattcctcaacacttttaaaatgctgaagtatattttgagcttctgggaagggcctacaggacaatgtgtccaaaattttatgaccatagagtcctctccccctggaagcattgcctgactttgaaattctactgaaaatattttagatactactgttgctccagtagtgctatactagagaagagaaaggcaagggctagaatggcttctgtttttatttcatagacttctgcatcgcctgaaatgttgtgagctcacattaatttgggaaataaaataagtatcatttacatgaataaagaataataccatgtacattcccaatagaatgtatttatagatacatgagaagaaatatgtgtgtactaaacataggtccatatctcataattattatgcaaaagcaaaagaggaaacatattcatgtactgtctgatgagtattataatgatacagcaatgaacagagttctgtaaaactgggcactgctcaaagtgaacagcatatgttaactcatttaattatcataataatcccctgaaacatatgtaattatctccatgtgtcagatgaggaacctgggacacaggtaagttaatttacgtctcaaaagtcctactagttacttacgtaaggaagtttgtggaagaacctgataccaagtgtttttctacaaaatttcatactacttatgactcccacataaacctattttgcaaggaattctggaagccttgtgaggacttctgaaacctacataaagactaattagggctcccaggatgttatttttgccttctttaactttccatccaccttatcctgctttttgcactttggttattgagaaatcaaaaaaatatatatatagttaataccaaaatatattttggaagaaacaaatactataaaatctgatttagcaatataaaagtaatattaattttaatgatttgcctgattcttattcattcatagacatttgatgagcatctactaagtaaagctgcaggaaatataagtataaattagaaactctttccaccttaaaaatatgcttgtgggtttactggagaagacaggtatttaaacatcagcagcttttttctaccagtggcaagatttatgttgactcctgaacagtctctcttgaggtcttccttgctaccagagacacatgcacacacacatctgtatgaggattagccaggtggggctgttaactcatcactggatcacagcacaactatccttcccccaaggttataactgtacccacaaccttataacttgcctatttttctgtgatgctttaatcatgcacagatgtatgattaggctataggcaaaactcatgcaaaacgtaataaaaggaaaaggagaatgaaactaaaacagaagtccctatcattattacagaacaaaaaaagagagagaaaatggactaaccgcttagactagattttggaaaataattgacagttatgaaaaagaataagaacaaatgcttacatagtgttaaccttgagccagacactgcaggtgctttatatattttgcctttttatcctcaagaactctataagataaatactattattatcttctttttactgatgaagaaactgagacacagaaaggataagcatggtgcccaacattacaaattgggtaagttcttgggcctgggttcaaattcagatgattgcgtcagaatcaacactctggaccaccaccaggacatctgtgatacaaagttgagtaagtactgaccaagtcacccctctttgctggcaactgcacctaatgttatacatatgtatgagaacatgtggtatttgcttttctgttcctgcattagtttgcttagaataatagcctccagctccatccatattgctccaaaggacaggatctcattttttcatggctgtatagtattccatattcacaaccaatctataaggtaaatcttatccccacttgttaataaaggaaaactaagaacagataactattattgactgggtttggatgaaaacacaaggctatttgaattcaacacagtgtgcttttagggggaaattgtctttggacttcagttctgtgaaagtacaagtcatatcttatttagtttagattctaaaaccatagcatgtttttattaatttttaattattaaggatacataatgggtgtatatatttatttgatattttgatacaggcatataatgtgtaatgattcaatcagggtaattggggcatctgttacctcaagcatttatcatttatttttgttaccaacattctaactccactcttttagttgttttaaaatatagaataaattattgtcgagtatagtcatcctcttgtgctatcaaacactagattttatttattccatctaaccatgtatttgtactcattaactatcccatagcatagagccccaaagcaaggattttttttctactgcaaattgcatcaatttgaattaaaagtgaactaatctaagtcccttttttattcaagaaaataaatctagtaatgaaagaggaaaattatatggatcatccctaaggacaagttttataaagtactttaaaaaaatgtatgagatgtacttaggattcctgcctagtaagccatttaatggaatctttgcactggtcttaaatgcgtctgtgtactgcttgaaacctctatcactcctttccttttaaatctgttcctcatattaaataattcttacctaggttttcacatgaatggtgcctaggcagatgcaagaagctgctgctagggaaataaaatggaaactcagaaatgaaggaagctgagaattgccaagcagccacagactcccactctatacccgcttcctcaccccaccctttcccacatgtcacatacacattccaattttcccttgcagaggaaatgaagcaaaacacatcaatggagtgaaatggtttgtccctaagaatcagaaaactaaagcttctcttagcaggtacaaaaaaaaatagcttttcttttagttaagtaagactcctaggcaaaacatcaaaatcctgggctcttgataacttttttgacatagaaatatttatagagatggctctttatcaatgattccagaaactgtttgacttgaagttgaaaaatgacttcaaggtataaaaatctggcattagcaccaagatgttgaccctgaattctcttatttttaaagattaaaaacaaactcataactcctcaatgttaaatatgttttctggacccaaaaatgtttttcattttacgttgataaattactatgttccaaagcggactgcttttctcctcctgggaaaaaaaaataatgtatgtttcatattgatattcttctctttttaaaattaacctccaaaaaaagctacataaacacatgccaaaaagtgacatgttcaaagaagaaatgaaaaatgtcactgtgtgtatataccaacctcccgtgtgtatacttttttaatgagatcattattttgcatactgttttgaaacttgttcttttaatttaagaaatatgttctgagtatcttttcaacacagttgtatttgccattctcatgggacttgtggtgaatagatgggagaatttatcaacatgcaaatgaaacaaggctcttgcccgagctgagtgaacttgggccaaggaagatgacactgattaggtgagagaggaaaccaagcttagaaggggcagaagtctgggacctaaaagaggcagccaggaaaccacattggttatgacagagccttttcaaggtcaggaagggaagttcatgacctggcaagcaacaactaggtagatgtaagagcacattaccgtgcccttatgaggagccagaactagtcattgtaagctaagcacttcatgtctattaaatatgtattctttacagacaatagtccatgagctggatccagctgaggattttatagaagaagtagaggctcagaaaagttaaataatttgcctgagatcacacagcttgttagagcagggattgtagtcagggtgttttcctcccaaaggcacagcatgttccatttcaacccacagacaagctttattctttatccagtgccctttttcacaatgtccctccttctgcctctgtacttgtacacatggttaaatataaattcatctcccagaaaatcttcaacaggtcttggtgcaaaagactcagggttcttcaatgagctcaatgcatgttaactggtaaatctcatggcttatgttcatggagtatgtgtatgtgtgtggagtgtgctagagtgtgcacccatgagtctagcatatgtttatacaaacatttgtgtacaaataggtatgtgtagatgcacatacaaaattataaacctcactgatcttaataaccattttctacatattttcaaaggcagggaattaggtctatgacaactaggtatcaaactttccaaaagctaataagagatgatttacggctaacacagacacaagagaagtacaaatgcaccaccattaaaaatatctgatgatggccaggtgcggtggctcacgcctgtaatcccagcactttgggaggccgaggcgggtggatcatgaggtcaggagatcgagaccatcctggataacatggtgaaaccctgtctctattaaaatacaaaaaaaaaaaattagccaggcatggtggtgggcgcctgtagtcccagctactcgggaggctgaggcaggagaatggcgtgaagccgggaggtggaggttgcagtgagtcaagatcgcgccgctgcactccagcctgggcgacagagttagactccgcctcaaaaaaaaaaaaaaaaagaaagaaagaaagaaagaaagaaagaaagaaagaaagaaagaaagaaagaaagaaagaaagaaagaaaaaaaaagaaaaaagtctgatgaataaatcttcatcactgaaattcagaatacaagtagaaaattccgtctatgtattggagtttgactatatttgtgaaggcacagtatataaacacctttcaggaattcatctgttgctttaagagaagtctgagagttttttcttaagcattttcaacataataaataaactactatttgaacacattttgctgggtcttctccctgagatattttacaaattatttggatcgatagtacaaaattgcagtcaaaccactaggaaatgggattttaagtcagtgccttagcctcatcacacatctggaggacaccattcccatacccttcctaccttgttcaattttaagtcttccatggtggtacctccatcgtctgagctacaatatttgtttttgcaaatttggagggttgtactaacagatactctctacatttcttgcttttttccctattctctcatttgccaccgagtctttcccttctctttgaacacgtctgtaagaatgatcttgcagtaatatacccaagaaaatgcctcctttatctaagtcaggaagagtgttcttttaaaactatgactgcgaatctcaaatgggcactcagcactgcccggcaatcttctcacatttgctcggtaaattcacttccccaggctctgataagactatatggtatttcctttctccttgaaatatcaattactccccaccacacaaatgcttttcacctcaccctacttcatactaactaagaagaaagcagttggacacaatatctctcaacttcccattatggatacaccaatatctaagcctatattctctgctttccctagcatataatgcagagacagagaggctttgctgcaactaaagccaactcctttacaatatcagggacctcagtggttttttccctatagcatccccagcacctagaagagtacccagcaggagctcagtaattataaattcaatgaatgaatgaatggatgaatgaatgaatatctatgactatgaaagattctatctgtcctaaacggggaggaggacaagcatcaggacaaacagttttagggtgatactcgacatctgtaggacatggatagataaccatatgtaaaacaaatgataataaataggagataatattcacccttgcctcatctactctgtctgtcttatctggcttcttacattgtatctaataattaatggttacattcataggatatattaatagagccagctaccttccattcatctctataagtcttaacaacagtgaccaatttacataagatgaaactgaagctcaaaggagtcaagtatgttacccaatgtcaactcttaaatgaaggaggtagggttcaagtctatggatttttttaaatggtaaagtccatactctctccactcagccacgctgtcaatcagcccctgagaccttcctgtaagtccgagttcaactgagtttcttagccaatccttcgggaaataggactacattctactgcagtctactggaaatgtcatgctgtcaaataatcccatcctaattgtgtcaggcatgaagtctaaatggccacagagataggcagagagacagggggacccctaatgggaactttatatctaccctctgtcttataggattggatcttgctttctgtgttcccagtcatgaattttaatcatgtaagaaaagacaagatcttttaagattacaacaggagcagatcttggtattgtgggatctgaaacacatatgatttggggaagtggggtctatgagaaaagaattaaaaaatcatatgtaaaattgggcatggaagttaacatttatttagactaggaatgggaaggggtccatgcatttgaaagtctctgtagcttaatcttcatttacttcaaacctaattctgcctctgatcatgatctagccctatctgggaggcaggaacacggtggttgagagcctttgttctccaggtgggcagcctgattttgaatcccgccttgaccacttctagttatatgatcttaggtgagtggctgaaatttcacaagcatatactttgtcatttgttaaattttcaaatacaactggatcataaaaactgttaatatgaatgatcatataaattcttgatcatagtgcctgacatatgctcaacaaagtgctcattaaggtgtgtttgatattattagcatctaatgccatcttcttgcttaccagctctggaacctctctatttgagactcccctactatattcatttgatacctcctgaatgcctgagcaccaggcacttaggatttgactctgtgtcttcccattatgtaccttcaacaacaagatctgggccctaactccctgctgaaccaaagcctggttcccagcctcactacaactgtgtcatcgcattttggcatacctattagttttataagaatccttgtttctgcctgtgtaccagtaaaccttccccattttcctgggcataatccaataaaactagaaaaaagtaatatcatgaaaagcattcacaatagatttttaagtgaagagctagaattcctataattgtggctaataaggttgtttttacagggatatgcaaaaatttaatactacaaatatgtaaaatggtgaggtcctcacctagaatataatgatcactctattatagataatgtaattattacaatatgtatgctaccaaatagcattgtgatttctaacaagtcaattaaccttcctgggcctcaatttactcataaaatgaggaagctggactacactttctatgattcttgctagttccaataaatatgtattagtacatatacctgggatattaatgtatcattcacatctcaacttggaatgtgcccaatttgaatatttccctttgaagctgataagtgagggagaaggaactactcaaaggataacaacattgtcttctttttttgtgtgtgaaattcacctttttacctctactgtcacaatattctcactatggcaagtgttcaaggaatattatttgacttttcgaaattccttctctagtaaagtcctattaagacaattaacattgctcctaaaagtgtaattataagtgtggtatatatcccagcttgttgaagcaacctggtaagaagaaatgaagactagacctgctcaccccatgtggaaggtagagggaaaacctagatcaatgaagagcagtgaagttttggcttgcgctcacacgaaagattgggccacaggcagttgtttcatataaaggaagtctgaaaataagtgttgaatccatgccctggtggtatctggtgcagagcaaagaggtgtcttggagtaggcagctatggtacagaaacaatatcagggcgtataaaagaaggtagaatcaggaactgtgtagagactttctatttgaacccttcaatggctttccagtaacaaacagtaagttctaaagtccttataatggccctgtaggatatgaccttggctctccctccattgctcctcccattaccctggcaagctcactctgcttcagctacactagcctgcctgtgctccttggatatatgaagcacacttctaaccagagtctcttgtatgtggcggttcctttgcctggaatgctcttatcccagactctctcatgtctcatgcactcatttaagtattttcaaacaagtcagttctttggaaaggctttctctgacaaccctttgataaataacaccctgtttctgtccccatgctatattttgtgcttgtctctattaaatattggattatatattcctatatattcctttatttatatttttgtcttgcttccccaatagtatatacatttctcaaactctgcaactgtgttcatatactgtgcttaggacaacatatggaccacaatagaggcacatgcagttagtgaatgaatgaatgaatgaatgaatgaatgaaatccactacaactactttgattcttatttttgtagcatttacggtttgtatctcaaaactcagcagatgaacttgcaagaatggaggctttatctgttctgcttatggctgaatccccactgtctagaacagtagctggcacttgggagttctcaatagataatcttaaatgttgtttaccatgaaaaagttcttgtactctagttttaagaacggaaatgaattgttctttgattttggtaacaagtcaccatcagaaccagttttaaactcaacccaatcaatcaatgacaattttgcattagtaaccatgctttggaaagcctaaaactctatatagcaacagcagtgtttggttttgagtgacagcatcttacaagcacagctctcacttgtttaccaagcaatgaagcaacttttggtttaaggcattgagctgtggtctctctctctctctctttttttttttgatggaaagatgatggttcttagctataatggcaaaagacaaataacttattataatcttatacagggttctaagcatatagaaataccaactatattaatccacaaaacaagcaggagagggaggtgctatgattattccaatttagtagacaaagaaactgaagtactgagggttggagtgcttatccaatgtctacagccaaggtgtattccagctgggattattattaaatccaattattttggcttcagagtctgtgttcttagtttctacattctatggcttccctatgagaactgaaacacacacttgttataattccaggagccagatttgtcttgatgattagtctactgacttaatcaaatgcttttcaaataattgtcataaacagtctggccggtgggggtgaatttcaaacagagaggtaagggcagacatctgtgggatggtggcaccaaagcaagcagttaggaaggtacagaatttagaatttaataatcggcatgttgaacaattaaggtaactgccctcgtgacttgtgtgtgtgtatatatttatatatgtatgtgtgtgtgtatacatacacacatacataagtacgtatgtgtgtgtgcgtgtgtttgtgtgtgtataaatatatgaatttctggtaagtcaagtgctatatcaaatatgtgtatatatatatatatatatatttggaaaggagatgaataattgttatttgaatgtggtaacaaatacccaccagaccagttttaaacccaacccaatcaatcagtgacatatatatttgttataggaccttggccttccaaaaattcatctgtggggtatctgaactggctaccagatggtaatggctcagtattactaaacgtattcagacaagtcatagaggtgaaaaacacctcaatttatggctaagtccctcagcctgatagttctttgtaatggcacctatttctaaccttaaagttatgccaaaaagcaacttcactatcactcggccctaaattcttggaccataagcagaataacaagagagctacaatttgaataagcattttatgaaacaggttatgtttgaagtttatcttctgaatataattcattagctttttctttgcagaaaagagttctgtcaataaccaatcatttttagttcatttcgtctctctgggactcagtttccttatctataagatgatcaatttgaaactggcagtttctgcaggatgttttgttctatgaaaccttgaaaaatcagagctacaattatgtaaattactgatatatcttctcttatttttccctcttcctcatttttctgggttcactatagtacctatgcttttactaatgtctctacatagagctagaagcaaaaaaaaaatgaatcagattcttaaatacaatttttttaatgggcatattctgtaagagaagttcatactgtgtatgacttttatgtatctctgtatgttttatcttacttgggaatatttatcttgtgcagtcacaatgaatgccttttggattggcgctacaataaagatattggaattaatctagactccttcatttacttccttgtgatcttaagcaagttattattctccctgaacttctagtttattcatctgcaaaatcaaaatatcactttcagtcttgcatgattgagatgataattccaaggcgaggcatatgcaacactttttttcatcctctttgtcttatacaggttctcaactaaggtaagctttcttccctcccttgtactctgttctcaataactagaaccatcagtgctccttcttgttttttacttgctgagaaaggttggggtgtgtgttttctgttgatgaccatcttcatcaagccttaaaacccaattgatgcttgtgttatgctttaattcaatgctggatgcacttacttcaaaatattactccaatatggatcatcttactgccttcatccatgcttcagtcaacccaatccatacatctcagaccttttcataaataacagtcgtcctggattcaaggtctcactttttctcagtagcatcttatgttgaatttcctcctttctccaatcaccagcccttctctgccccatctatttccagccatcccatttgtctcccaaagcaaaacagatcgactctcagtttgagaataaacatttctgtctattttcttttcaaattttaccccagatcccaactaaagtgtgcgcttgatttgactgaaatttaatgctgatttattcatgttacaagagtttgtttaatttataacatggtgcctttataatattattttactgtgtttagaagattacagtacacatgcttatgcttgttaaataatgtaagtgattgagagtatttcatgcatagaatgcgtccaagaaaggcttgtggaaaaccattaatggatgcctaatttaacactttctcccctttgcaaaattattagccattgcccttgatgttgtaatgcttaggaaatgaaaattatgtaataagatacggagtctgatggcctgagtttgaattccagttttatgacttactagctgagttaaccttgatccaaattcagtggactctataggtctaagttttcttatatctaaagcgtaagtgattacctatctcaaaggatttggtgaagattaaataagatatagccatactatactatattacatgaataatatatctatactatactctgtttaacacatgtctgacatataggtgataataaaaagatattaatattatttataattgttttattttatagctaaaaattaggattatgtcagtcaaataatagtctaaaatcacatgactaataataagtgaagctgtgattagaatccaagttaaataactttagatcctctgagtgtaatctctgaatatactaaatctttttcttccaatagttcccttttaggcattaatgttcttgaaataagaaaagatgaaccataagagaccctaaaggcggtatatgtattccctttatttcattactagatggtgtaaaaagattgtatgtttaagttttctaatataaagtatttttctctttcttaaactttacagtttacaaagacttctctgataccccaaaacacataagcgttggcatgccattgcactggaggaaccagaatgctgggagaattagaacaagactctgtgaatttcaactaagctatttgagatggaaatcagcccctcctagtcatctctggccccttggtccttattaagcaacatggtctgaacacgccatcagtgatgtttttgaatttgcccaacttactgacagatccagcacttccccacttctgtcaacagcacagcagaattaagaacttgggttctaaaaatccatctttgtgtatacagctaatattttgattaagcctcttgggggaagcttgtattacagtattacagatatttgctaaataaggtgagttgaataaatacaaaagacagcctagtccttaccctaagaaggacttagattaccagttgatttctttttgtctttttatcaaagataattaccaataacagtgacttttttcaagtcatgtgtgataatgcatttttgtgaaattttgcttttattaagggtggtagaaggatggttctttcttaattcagtaactgcttcagcataatttaatacatatttagatgaaaagtagatattttcacagcccagtgttacatatagagataatgaaattgctttgccattaaaattttgattcaatttctccctggaatgcattaacagaaaaccactttcatttttatagttgaaagaaaaaggcaatttactgttgtgaagtttcaggagtattccaaaccagcataattctggagcctcctaaactccccactaagtagagagagtctatgaatttaaaacactggccacaggtattgtgttttatccttagaaatctgcttctcattattattttcatgcctactgcactggcattaagattacttttcttcaaaagaaaatgtaataaatattaatggaattaccaaaaaagttaataaatgagttaataaataataatatgatgtgcttacttgttattgaaactcttaagtttcgagaaacggtatcatgaggatgcctgaaacagcagccccacacgtcaaattctagagctacaggaaaggatgtttctctattctcttgaaatacaatgaatatttccctgaggtatgatgaattatcctactatggaagagaaggaaagattagtctaaccattatactgtatatcaattccaaaataggccgctgatatctattttatggtaaatgatatgtgttacataaattctcaaattttaatttcctgttacactcattgaagttttgaaattgaaagttccatggagattatcaagcccagttttctcattttagaaaactagagaggtaaagtgacttaatccaaggttagagaaagcaagagagtagcagaggaggcataagcatttgtgctccaactactattttatattctcaggagaaagaatgttacctgctaactgtaactcttgggttataaacatatgacatggatctctgtgtagtattatgtattcatgaatatcacacatagatcagaacaggacccaagactcaaggacctaatccccagtcttctacaatgaaggagaactcaaatcacttaaagataagcaaatacaaataatttaaacttttatattaccaatttattttgaagtacatgtattctacacatagataaaagcaaaataacaactacattatacaaatgtcatattttatatgtccttcagaacaatatgcatatttcaaatataataatacaaaaaaactacattgtgaataccatgtatactataaaacagttgtaagtttacatgaggaggtttaatgatttagggaaaaagttcacaatcatcctcataaggctttaacctaggttcaagattttctacttaatattcaaattctttcataggacaattgagcagacagaaataagaaaggtgaaataaatcattatcttctgaacttagacatgcaaaatggtgcaggaggaaaggaactctcaggcgaaaagaaatcggaatgaaatgagcatcagtacttttttttaagaaagtttcagaagaaaactatgaagatgctagcttgataataaacattgcttatccttctattaattaaaattaggctgtaactgtagagtgcacacattctgatctatagacttaaactacacacaatcagctatatcaatctattcatttgttttttatctccagctagcaaagtatttagtcaaattaaatcttgttttaaagggcttctcactctaagatttactttggagatttgtcttatacagacttccaaatgaaaaacactattgctttctatctctgtcaacttttattcattaaatatttcttccttaatgtggttatcaacattttactatttataattacttcctaacaatcactggaaatcatatatgaagtttatattaaagtttctgagatagtgcattctctccatagtattagtccaagattgtcctggagaatgctgatattgtaaaacgtaaagtacaagagagaaattgttcatacaaatcagtacagctttgaattcaagcaataataaaaaggaaagacttcatagaggttagcagctcttagaggaaggaaacacaagttctcatttgggagagggaatatttgtgctcctgaaacaagcagaaccaatactagagtaggtgtcatcaccaaatccagattcaaagccttccacacaagagctgaaagaatggccacacaacatccatgaaatgagatgaaacaagtccctcaacagagctaggaattctgagattgttccatgaattgtcagtctcacagagaataaaaaccagttcattaaaatgggacatcccaatcacatttgccaactaaaataacacacacaaatgaacagagaagccaaaccaagttactggtttcatgagagtgtacaacatgaagtcagttttaaagagcaatggccacttctagattttagaacttatcctctttctagaactacagatatttccatcagagagggctaccaaaagcattctgcaacttattttaaaattaaataaacaaacccagctctccaccatcccccgcctcctgcgccctgcatcccccgccccatgagttataaatgtaggtttctggtaacctacatcagagtgacacacttattttaatttgatgtttgctatttgtaaatgcaatctcatttatgttacactgtggcagccattctctggagggctggattagttgtggatgtaaatacatttataatgtattttcctttttacttaagtttaaaatttgaagcaaggaaaatatctaaacataactacgtcaaacatcatctagagcttcttttaaaaattgctctgccaactttagagaaacaatgactggctgtatgcaaacacactctcaaaatgtgttctgagcagttagaaaattataatgtaaatttactcagattcccagagaaacatttaatttaggaaacaataaggacaaatacaaaatgtattgtttaaacaaagaggtgattgataaggagaacaggagaacaagcctctaatgaacataaacagcaatacttgaaaaacaattggctacctggaatctatgttaaagtctgttatatgagttagagtcttttccccttagaatctctgttagcatgtaaaataggtaacattataaacacttctccagaagactttatgaaaagcctgtcattctcaggctccaaccttagaccataagaaattatgtctatttatttccatttgatcaatgtatttgcatagcaagaaatgagtgatctcacaatatacccaaataaaatttgccgatacaataaaaggaggtactagataaaataatcaagcatcagtatggactaaatactctcaaaataagcaggtagatccattacaaacccttaattacttcagtttttgttctgacatttttgatccaaagtgtttctcctagttttaacattctcttgtgaaaacattactgcaacttacaaaaagtttatttcattaatctttcctaccctgaaaaacctggcttccttcatgtccatcccagagtaacatttctctgatctcatttcaggtgcctcttacattcacctaagacattttcattgcaaaacagagaatttttagaagtcactaaaaagcactcccttaccttctaaacctgcttcaatcagcccaaactgttccaataatttaacaaaaagcacaatgacgatcagaactgctatcatttcaagcccttccaagttcat

SEQ ID NO: 363 - DNA, 816041 bp, Homo sapiens
aacattttattttgcttttattttttctttttgaaatacaaaatgtgcacattgagtttacacaaacacgtgatggcaaatttcagtgtacatgtattgtactactcttaatttctacactggtgatagcagggcagctttcaacatcctatctctacaccagaatagatacctgatttattgttgcaaagacagttgcaaatttcctccttctgtagcctcttggtctttgtgatatttctacaaaacagggacgatgtgtgtggctttagtaatgtggcaactttacagttttggctaagatgattaaaaataatctgaattatgatgagctaaatcatactgtaatctggattagttgttgagcacttattttctactaaatcttggtagtagttgtcaatgtaatggaaccactggtgctttcaaagtgaattttgcttgctaattttgcttgctgtttgttcttagtagacagtggggtagtcaaggtttctttctttgtccctgaatggcttgtaatataaataaacatgctgtaaggaagtcaggggaaagaggacagatttggcctttaatgctgttaggattacttgttattaagcattactatatactggaggatagatatcctgaccctttgcatatgtctgtaaacatccttgttttgtttgatgccttcttcaacttccacttaatgattgatactaatgattgatacaatagaaaacagcctgtaagaaagattgaacaaatccaaaattattatataggccttggctgtaacatattatggaaaattaaatgcttattaaaataagttttattaggcatatgctgatatctgataataaactaatttttaaatgtttaataatttttaaatgtttaaaaatgccagataaaactaatttctaacagaaggtgggaaggccatagaaactggaactatgtgtttttttaattgttgtaatcttgtttccttaaagtatataaatggaatttaaatggaattacagcattcaaacatgaaaattaatttaatttctggaaattaaatgcagatgtcactatattagaaaaccattcaaaatcctaggactgaatacatacaaatgagtagcaaaaaacactgatattttaaaatcactgatatgtgaaagcctcaataatcccatggctaaggaaccaataaaactatatgccagattctattacttttgaatattcacagagtatgaaatgagttagaccatcccctgaactcagtggcattatgaaaaggatgcaaatttataactgaaagctcaaatcttttggggattgctttatattaaaacaaagcttgtttgcataatatgcttcagtgtcaagctgagcaatctatgctaaaagtggtagctccaactttaagggtggtagaatagttcacatttgtctgttggattcaggatctatttgacaagttaaatcacattttcaaagagctgcatggagcgcattatgttttcatcctgtaagggagaaacacagagcgattaaattcagcatatctgcaaggaaaagtacactattttgcccctgagtattgcctcctcccatcaaccacctcaaccacctatgccaaaagctcaaatattaagtgtttgcaaatgtaaatgccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctgggattacagttgtgagctactgtaccaggccttaacaatttttaactgtggttctgcccacacatcaagtcaaataattctaagtaagctaacactggtttctttgataacaggctactacctggagttctcttcagagaaaattttccactgtttattttttgtgactgaagaccattagtgagttcagtcaaagagccatttcttgtccacatacactaaaacaatgacttttctcttagaaatcagatagaagcttggcctgttgtgatgccatacttggctatctaggaattctaatgctgtggagatatgatagataatatatgagtgatgctaagttttggcaaagagcaattcaaatctcatgtatgttttatcctccatgaatactctctaaggaatttgggaatcaacacagtacatgtacaacttttgtatccccagggtttcctccatagcctgactcagtgggcactctaaatgttgattatgtaattggtgcttgttttcagagtggtaggcttatgctgcatgttgtagaagtggtaaacttaggcatatgatctctatatttcgcccagttcatggtagctagctgctaatactcagtttagctgttatgatagctgaattgatagttattacactttcattacttactttttggcagctttcaatgaactcatctatggtaacaaccccatctttatttttgtccattttctgttcaggaagaaaacaaaaattgtatttagacttatcccttaataccctcacacctggaccaaatgagctgaagctgataaaaagaaaacctagctgcttatttatttcacgtggaggaactgtttcagagcaggaaccagcagttttttagagataaaaatgatagggccaaatgcttctggcttttcccttttcaatataatgtggtgaagatgtagagtcactctgtcctaggtaaaatcccaccttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagtctaatttttgccttaccactttcattcttatgagagtaaaaataatctctaataacttaaacatttagatttattgttgcacatttgtttcacgtgaaagatctctcaattaggttaatacagagcgaatatatatttacttttaagagtattcaattataaatgatagagtaatttgtaaacaggtgaaaccttttaagatgttttaagcatagataagtagcaagtagtttgttagacacaggcagaattcttgagatgtgttaaacacagaggtaagaattgaagaacaagagatatttaaggtatcctaagtatctgggtaataaatattcatgatataaaaatatacaagaagcactatttaggatatgctccatatacatgaacacaatagccataaggtcttaatttggcacccactagtgatacctattctggccccaggtgtcctctgtgcaagaaacacaaatgaaacccattactacttatcaggctatactcgtgacctggcacacttgcacctgtgtctctccagtagcgcaagttcatgtcatttgctgttggccctgggcaccttttgtctgtggggcctcttgctcaaaactcaattctggggaagtctcgtgaggcaaagagagacaggacataggcacactgagaatgcccaggatttagggagtggtctttcaaccccatttgcagcctgtcctgcgtggttaacttactccatccctttctttacttctcgctgtgttttaaattggtttaataaactgtgtaatacgagtatcttaatttggtctgtgaaccttgtttcctggatagtctgcctcaacgtgcatttggagaccccaccattgcgtcaggtcattccacaatccccatgattgtaaaatttcatttccttatggatcacatgctgtggggaaaagaaaggcttcaggctaaatgttgaaacatgggttggatacattttctttctatctgattccaaccatgatctttattccattcacagtatttattaagatgccagcaggaaacaagggtgtaatctttatgtgttatatatttactttggagcttcaccataaactacttctatcccaagtttttaattgtacatctttcttccactacataaaatattttggaatttcctcaaaaaaacttttcaaattaataattgcaattaatattttaaagttaagaaatgaaaatggtccaaattactgtgatgttggtgaggcatcccttacctctttagtgatgtagccatctttatttatgtcatacagattaaatgcccaattgagtttttcttgtactgtcccccggagcaaaatggaaagacctttgatgaaatcctgaaaagaaataaaaattcaattttatatgacatttttaaaaaaacaaaaacaaaaaaaacaaatgatgtaagtaagggctacaaccctctggatcttgaacatttagcaaaatgattgatgtgttattggttgtctagttttcagacttctctgtgggcataaatcactccttagtcttaacattttcatattctaattggaaactgagttaaatcaatggtcatactggaaattgtaccagtgcgtacccacacagctagaggcttgagtataagtggtattggctttccactgcaagtgcacatgatttactaaaagaatctaataatagttttttcaaaaaaatacaagtgcacacataacacacttcaatgaaaaaccgtttgctaataagaaatgtggctgtccataaaagataaaccaattgtggtctttaattagaaatccagttataatttacatgtggacagtgggtaagagcatggaactggaaaggacagactgcctggattcaccctccagctatattactggatggctttgtgtcttcaggcaacttaacatccctttgcctcaattttcgtatctgtaaaatggagctaataatagtatctacctcttcacaattttatgaggattaaaaaagaggctgcttataacagtccttggcaatgacattggctatgtaagtttttgttaagtaaatggagccctcagtttgtatcctggttagattgcattgcagactggccagattaacttgattaaattcatttagtgtttttttttttgtttttttttttttttttgagatggaatctcgcactgttgcccaggctggagtgcagtggcacaatcttggctcactgcaacttccacctcccacctcccaggttcaagccattcttctgcctcagcctcccgagtagctgggactacaggcacccgccaccatgcctgactaatttttgtatttttggtagagatggggtttcaccatgttggccaggttggtgtcgaactcctgaccttgtgatctgcccaccgccgcctctcaaagtgctgggattacaggcgtgagccaccacgcctggccagatttcttgttgttatgtacagcagggttaacgttacaatgtgctgtattcagtttataatccacttttaggtaggaatgaaagcagaggggaaatccaaaagtcttctgggtgaatttgcattatatctccctttctcacattccttccttttatagctgtatttctatctgaatttctcaaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataattgtcaaattcatattgcaagggaccctgaatagcccagtcaattttaagaaagaaaaacaaacttggaggactcacactgcccaatatcaaaacttagtacaaagttacattaatcaaaacagtgtggtactggcataaagacagatatatagaacagtagaatagaattgagtctagatataaaccagctgtctgtggccaattgattttcgataatggtgccaagaccattcaatagctatggaaagaataatctcaatatatggtgctgtggcaactggatcaccatacttagtttgcttcccattggcatgaagggtagaatgtcaagtgagagaaaaacaagattccagagaaagccacaaggaattccaatatttggcaggtacagagaggagaagctggcaaagcatcttgaaaagaagttgctaaagaagtgagtcaggagaacagagcatttccctaggaaaggattgttcattttgctccaaggttggaaaaatgttcactggaccagcaacatggaggtcaccagcaagtgatagggaacggtccagtggagtaggagtgaagagtaatttttaatgaggagcactttgaatactgaagagaagaatctaaaaagagtaagagtcagaaatgggctgtgctcttgagaaggtggggaggatccagaacatgggtagatgggccgatctgagaagggagttgatacatgagacagaagaacatggtgtggatgccagcagctgctttgcaggtgggaagatgactgtgtttctgtccgatagctttagtgagtgtgagctgtttgagagtgaggagcctggtagaagaggtaagaatctgaggtttgaggagagaggcagaagctctgatactaagcagtaagatgacatgcaaattagagaaagggagacctccctcaaattatttccctgccatattttagaaaattatttatgacatagaatgtagtttagttaaaaggtaatgacagcccttggaggtatgagtgtacatcttgcacaaccagcaggctggggatcatggctcatgcctgtaatcccagcactttgggtggtggaggtgggaaggttgtttgagtccaagagtttgcaagcagcctgagcaacgcagccagatccaaattaacagcaagaaaaacaaattaactgggtatggtggtgcacacctgttgtcccagctacctgggaggctgagatgggaatcacttgagcccagaaggtcgaggctacagtgaactatgattgcaccactgtgcttcagcctggatgacagaccaagactctgtctcaaaaaaaaaaaaaaaatccttagctttttcagaaggcataaaatatacattgcagaacatagagccttattcaaggaagattgctgagcagttttgaaaggctagatgagattgattgttatcaatgtaaacgatatttttaaaaattcacagcgtagtaataatatgtcattaattgtaaggggagctggccacagggtctttgaaaacatgcttagagtattggttctcaaaatataatgtgcaacacagtcacctggggagtgtgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcacccaggaagcgcaaggggttggggaattccctttcctagccaagggaagctgtgacagatggtacctggagaatcaggacacttcctgccaatattgtgcttttccaacagtcttagcaaacggcacaccaggagattatatactgcacctggctcagagtggcccacacccacagagccttgctcactgctatcacagaagtccgagatcgaactgcaaggcaacagtgaggctgagggaggggcgtccaccattgctgagacttgactaggtaaagcagccaggaagctcaaactaggtggagcccactgcagctcaaggaggcctgcctgcctctgtagatgccacctctgggggcaggtcatagctgaacaaaaggcagcagaaacttctgcagacttaaacatccctgtctgacagctttgaagagagtagttctcccagcatggagtttgagatctgagaacagacagactgcctcctcaagtgggtccctgacccccgagtagcataactgggaaacacctcctagtaggggcagactgacacctcatacagccaggtgcccctctaagacaaagcttccagaggaaggatcaggcagcaacatgtgctgttctgtagcctctgctggtgataaccaggcaaacagggtctggagtggacctccagcaaactccaacagacctgcagctgagggtcctgactgttagaaggaaaactgacaaacagaagggaatagcatcaacatcaacaaaaaggacatccacaccaaaaccccatctttaggtcaccatcatcaaagaccaaaggtagataaaaccagaaagatggagagaaaccagagcagaaaagctgaaaagtgtaaaaatcagagaacctcttctccaaaggaacgcacctcctcgccagcaatggaacaaagctggatggagaatgactttgatgagctgacagaagtaggcttcaaaagatcagtaataacaaacttctccgaactaaaggaagatgttcgaacccatcacaaagaagctaaaaaccttgagaaaagattagacgaatggctgactagaataaacagcgtagagaagaccttaaatgacctgacggagctgaaaaccatggcacaagaactatctgatgcattcacaagcttcagtagccattttgatcaagtggaagaaagggtatcagtgattgaagatcaagtgaatgaaatgaagcgagaagagaagtatagagaaaaatgagttaaacaaagcctccaggaaatatgggactatgtgaaaaggccaaatctacgtctgattggtgtacctgaaagtgacggggagaattgaaccaagttggaaaacacccttcaggatattatccaggagaacttgcgcaacctagcaagtcaggccaacattcaaattcaggaaatacagagaatgccaccaagatactccttaagagcaattccaagacacataaattgtcagattcaccaaagttgaaatgaaggaaagaaagttaagggcagccagggaggtcgggttacccacaaagggaagcccatcagactaacagcggaactctcggcagaaactttacaagccagaagagagtgggggccaatattcaacactcttacagaattttcaacccagaatttcataaccagccaaactaagcttcataagtgaaggagaaataaaatcctttacagacaagcaaatgctgagagattttgtcaccgccaggcctgccttacaagagcttctgaaggaagcactaaacatagaaaggaacaactgataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacagagacacaaaaaacccttcaaaaaatcaatgaatccaggagctggtgttttgaaaagatcaacaaaattgatagactgctagcaaggctaataaagaagaaaagagagaagaatcaaatagatgcaataaaaaatgataaaggggatatcaccactgatcccacagaaatacaaactaccatcagagaatacgatgaacacctctatgcgaataaactagaaaatctagaagaatggataaattcctggacacatacaccctcccaagactaaaccaggaagaagttgaatccctgaatagaccaataacaggctctgaaattgaggcaataattaatagcctgccaaccaaaaaaaagtccaggaccagatggattcacagctgaattctaccagaggtacaaagaggagctggtaccatttcttctgaaaatattccaatcaacagaaaaagagggaatcctccctaactcattttatgaggccagcatcatcctgataccaaagcctagcagagatacaacaaaaaagaattttagaccaatatccctgctgaacatcgatgcaaaaatcctcaataaaatattagcaaaccgaatccagcagcacatcaaaaagcttatccaccactatcattttggcttcatccctgggatgcaaggctggttcaacatacacaaatcaataaatgtaatccatcatataaacaaaaccaaagacaaaaaccacatgattatctcaacagacacagaagaggcctttgacaatattcagcagcccttcatgctaaaaactctcaataaactaggtattaatgggacgtatctcaaaataagagctatttatggcaaacccacagccaatatcatactgaatgggcaaaaactggactcattccctttgaaaactggcacaagacagggatgccctctctcaccactcctattcaacatagtgttggaagttctggccagggcaatcaggcaggagaaggaaataaagggtattcaattagggaaagaagaagtcaaattttccctgtttgcggatgacatgattgtatatttagaaaaccctgtcgtctcagcccaaaatctccttaaactgataagcaacttaagcgaagtctcagggtacaaaaatcaatgtgcaaaaatcacaggcattcctatacaccaataatagacaaacagagccaaatcatgagtgaactcccattcacaattgcttcaaagataataaaatacctaggaatccaacttatatgggatgtgaaggacccttataagggtgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagccctcggaaataataccacacatctacaaccatctgatctttgacaaacctgacagaaacaagcaatggggaaaggattccctatttaataaatggtgctgggaaaactggctagccatatgtagaaagctgaaactggatcccttccttacactttatacaaaaattaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaggaacttctgcacagcaaaagaaactaccatcagagtgaacaggcaacctacaaaatgggagaaaattttcgcaacctactcatctgacaaagggctaatatccagaatctacaaagaaattaaatttacaagaaaaaaaaaaacccttcaaaaagtgggcaaaggatatgaacagactcttctcaaaagaagacatttatgcagccaccagacacatgaaaaaatgctcatcatcactggccatcagagaaatgcaaatcaaaaccacaatgagataccatctcacaccagttagaatgacaatcattaagaagtcaggaaacaacagatgctggagaggatgtggagaaataggaacacttttgcactgttggtgggactgtaaactagttcaaccattgtggaagactggtgactcctcaaggagctagaactagaaataccatttgacccagcaatcccattactgggtatacacccaaaggattataaatcatgctgctttaaagacacatgcacatgtatgtttattgcggcactattcacagtagcaaagacttggtaccaacccaaatgtccatcaatgatagactggattaagaaaatgtggcacatatactggattaagaaaatatggcactatacagccataaaaaggatgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgactttataatagcctagacttgttcagttgtggattctgttcatctgccaaacctttaatgagtgcctcagtgctggccactatgctggggacaatcctcctgactcccctgactccctgccaatcaaagactgctatggcttagaatgatgcatttgcatgtagttgccttactgggtaatgagatgaccaatgtcattattaactggctttgttagaaaaattcccccaactagtgtaaattagttcaaccattgtggaagactgtggcgattcctcaaggatctagaactagaaataccatttgacacagccatcccattactgggtatatacctaaaggattataaatcattctactataaagacacatacacatgtatatgtattgcagcactattcacaatagcaaagacttggaaccaacccaaatgtccatcaataatacactggataaagaaaacgtggcacatatacaccatggaatactatgcagccataaaaaaggatgagttcatgtcctttgtggggaatgaagctggaaaccgtcattctcagcaaactatcatgagaacagtaaaccaaacattgcatgttctcactcatagctgggaattgaacaatgagaacacacggacataggaaggggaacatcacacaccagggcatgtcggagggtggggggctaggggagggataatattagcagaaatacctaatgtaggtgatgagttgatgggtgcagcaaaccaccatggcacgtgtatacctatgtgacaaaaatgcacactctgcacatgtatcccagaacttaaagtataattaaaaaaaaaatcccccaactgataactgctatagttaacatctaataactactgagcacatatttggtgccagacacagagccaagccctttactgacattatgactttttcatttttacattatcttattaagtagctttgattgctgatgttttagcagtatgaatgctaaggttaagaaggttaagtactcagcctagggtctcagagccgctgggtggcaaaatggagattagatcccatcataccaaatccagggcccctcctatcatatttcttctgcctttcaggtttaagcaaattaagtggaaaactcccattaccctttatcgtagaatcagatggtctctctactgtacctctcagtatgctattgctattattcaaaatgtgttcattccctaaccatttctattttctagagatttcccaggtagctaatcaatttagaaaagtaactgcaacagcctagttttaaatttgattttcattcaaactttattaatttagccattagttttcatttaaaaggaaaggcattttaccaacatgcatatcatatataatcattacaactaatttcccaaattataatcaacgttcattgcaattactggtattttacataaatattataaaagcaatgttatgcatggttccatatcattaacaccatactaaatttacatataaaattggatataatgtgccctaggaaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcctgatatactctgtccagcctctgccccactctccattgcttcccatcccattccaagcctttgttctcttaaggagctcctgactgtcctttagacagtccatcagttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttgatccagaagaattaactctgcctcctttagtttgtgctttcttcacaactgcttaccctctttctgtagaggactagagtttgagattcacaggaagaagcaacctacatagaggccattggtgacaaacattctctatgagtttctggctggcaatgctgtagtcttgggtgatgagattaacactgggacaagaaatggtcccataggtggatgtgaagattgagacttgtctggaatttgcttagtgtttggaagagaccatctctagaagtaaagtactaaaaatactaccaatgagacagagatgagttgctattattagtgtctctgtcattattagaactttcatcattgttacaactcagaaaatgatattgggaattagagaaggtgaaaaacatacccaaagtcacacagtgaagaaggagtaaatctgggacatgaacttaggtctttctgactctgagaaccaggctagccctcagccagtaccaggctagcccacaggcagtaaagttggctgatggattggggtcattggtgacttgggaagtttctgtggctgtgttggaaggggactgggtggtcctacatgttcctagttgtatgaagttgcatgaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaagaaccaaaattgggtctaaataacatgtaacactgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaatatcagtatgtacttcatagagttttttttttttttttttttgagacaaagtactgctcttgtcccccaggctggagtgcaatggcacgatctcgggtcactgcagcctccacctcctgggttcaagcgattctcctgcctcagcctcctgagtagctgggattacaggcacctgccaccatgcccggcgaatttttgtatgtttagtagagacagggtttcatcacgttggccagactggtctcgaactcctgacagcaggtgatcagcctgcctcagcctcccaaagtgctgggattacaggtgtgagccaccatgcccagccttcatagagatcttactaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaacgtaacatcttttcaccttaaataacttgctgtttttgtaggatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactgacttcttggaatctagatttcagtacagtccagggcttaaaagatataacaatgatctcccttctccgtctatgacctcttcgtgatcacattcctttacataacaaaaatagttactgagtttgttaagctgggattgcctcagtttcttataattttacttgtgaagctgaaaaataaatgttgagattttatagttgagcaacaaaatttacagattcttagggtgggaagacattttggatactatttagcattgtatttacattgaacaaaggtaaaaatagggacttgtagtgacatactgaggtcacctagttagttcatggtaaagttggcaatggaatcaagatattcctataccatctcttagaaatcgaggatactagagtagaaaaaacccctaggattcctttggtgtgactcctgcattttatagaggaacaacttgaggctaagaaaagtaaactactcgaggttacataccttggtggtggcagtctatccacaaactctgaacttagtccaaagttcttaacccaattatatcgagaacacagtgaatatagcaagtaaccctagagttcgttcttcatagtatttgaacaaacacacttgattatcatgccccaggtttgtagaatgaaatcaatctggtttatttctttttcctttcccacacccctactcccattgaattcaagcacgaggaatagaatcaccttcatgtatttgaatatacaattcatgacatcgttactatggtaagacaagttcatatgtgtgaatagtagcttctgtcaataagccctctgtaaatcaccctgaaaattgttagaaatactgtcctaggacaagaaggatactcagtgggtgaagtcttttttaaattttattttaatctttatgtctacagaactcatctgactcaagtgacttgcatacagcggctgcttaaaaaatgtttattgacagattattctgacttgagctcatttgttcattcattcattcattcattcattcattcaacaactgtttattatatgcctagtgtagacaacataagtgcattcctacaacatgagcaggaatagcccaggaaactatgatttttatgggctttaaaaatgtttagtgaactaaaagcttacacactaaagcttctgttgtatgtggagtttaagaagtttttgtgtaaccatataggcaatagcaccaacaaaccgtttcctctctgcttgccttacagtaggcatactttatcccctgccaacaagaggcttttgttcaatccagttttttctgacatccagctcaccaaacaagttgggtttgataaactgtttcacaaagcaatagagaaagctaacagcctgacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataattttaatgtggagctctatccaagttttagtatgtaataacttgatttgaaatgattgaaaaataacttaaagattttcatctgcattggtgctttgatattaatgcctattaagatgttggtaggcactcagatagtaaatataatttttctttaaaaaatccatgggttttaaacaatttagaaaaacatgaggtagttaattaattccccaaattaatctctcattaatgcagacagtgaactcattataatcctggcatcaggtactattaccaatacctgtctgtggtttgttagaagggccctcccctctgcactgtagtaatgagatggggtgggagagttgtcatccaaagtatatccaaattcacttaataacagtcttcctgtgttttcttagaattctaatttaattcttttaaaagtccaccgaaaacaaaaatttgttttgacatgttaggcacaaaattgttttaaatccactaaactagctaaaaccaaatggattaaaaccccaaaggaaatctgacttttgtatgaaacaactaatacttaagtgctgtacacttttcaaagagccttttacagatattattccactgtacagtgatagccagccaccatgtgaggtgggtgtcattcattcattcatgcaaaaagcatttatcaagtgctattacttgtcagccactgtcccatgacctgtggatacaacagtaaacaaagtggagaaatcctctgttcccctggagctgacattctagtggagagaaagaaacaacaatggtacaagtgaaatatatattattggattgtctcgagtgccgaaaagagacataaagcaggggaaggggatggggaatgtttaaggtgttgcaatttaagatagagtggtcagggcaagtctcactgagaaggtggcattggcgtaaatgcaaaggtgatgagatattgagatagatatttgggagaagataatttcaggcagagggaacagcaggttcaaaggcccaggagcagcatcatggctggtgtgctggtgggatggcaagggggccactgtggctgggtggggtaagttgggtgggagaatggtagaggataaggcagagaagggacaagagacagtagccaccatttgtaggccactctgtaggttgtggcttatgttctatggaatggtatggtttcgaacaggcagtaacatgatttgcttgcattttaacgggatcactctgactcattttaagagtagaccatggttaggggaggggtcatcagaatcagagaagtcagtttggagactactgtgtttattttggcaggagataacggtggctcctttaagtggaaagtagtaaaaaaaaaaaaagtgttggcaaggtcaatggcaaagtcaactctggccataataacagagagaaacagttgtcccctatattgagtagatgtcaaagttgaaaggaagtactagatggttccctcttgtcttgagataaaaccttcttcctgaactcccgattcatggactccactatcccatcgcatcactatctttttcctccaattctgaatcctatttatctcttttcttttctatcctaaagctattaacatctccttctttaccagtcttccctgtgtataaacaatgtccagtcttttctacattaaaagataaagtcttccactggtatctacccagcactatgatcagtttcctcatcacttcactcttccagcaaagctttttgtaagtgctgtctctattggttgtcgctgttttcttctcatcgtccttttcaccctctgcaatttggcttctgcttgtgcgctccactccctagtagttcatccagggcacttgggctgtcctgatcatgcccaacaatgactcccatgttgccacatcccaaagagaccttctgatccttaccttactggacttcatcatttcatttctgaactatctatctctcttgtgtttatttccataaactgttcattctctgtctcctttgttgatcccttttccttatggttcttgacatgtgttctggagtttcatgctggcctcatggagcttgcaaccttttataattcccccagtaacctcatctacatcatggatttaaccactacttcttgattaataattctcaaatctctatctctttctctgacttgtcctctgagcctcacatttgtgccaacttcttgttgagtctaaatccccacaggcacctcagatgtaatttgtccaaaactgagatcattatcgccctattcctcctgtaaagagtcacctggtgtccatgatggaatcctggaaggtatcacaaactcctctcttcatctctttatgccacaaaaagttagttcatcactaaattcttccatttttgtcatctaaatatgtctgtaatctgtccccacttctcattttctcctatgcatatacttatttaaagaccttattgttttgcctcctacagcagtaatcttctaattagtctccctgcctgcagtattgctgacctcaagttaatcttccactgacctatcagtgaaatgtatcccaaacacaaatcaaatctgactgtaaaagatcccacttaaacttatcagtggctttgcatcacctcaaggataaagtcccatttcttcatatggcatccttgactctctaggacatttcaccctccattgtacactctctaccctagccacacccaaatcctggcaatttcctgcaaatgcccatcttcagttctatgctctgaccctttgtttacaccccatttgcctaaaatgtcatgtccctactgccttttaaagcgggaagacatcatactcagaagtgaacttctcctgagaggtataatgggagagcgaaagactatacactttggaaatggatcaaactctctgcaccttagtttccacgtgtgtatctttaaaaaaatgaggattataggtagggttgttggatggtgaggcatgccagggacaggcacatattagatgctttctgaatggcaacaacttcagctcaggttcaactcatctggagagtctctttttatgtcctctctgtcctgcagctaatttaatcatgccagcactgtgctctcagaatattattttttaactcccataatcacagttatacttgagtttgacattgtccatctgctacactaggtataacattcttttgggcagagattacatcctattcctcttaattccccctacgtgatcagcacctcatgcatggctaggcacaccataggctgtgggacaaatataagttgggcatctgttaggtaattgaaagaaaaactataaggtccaatggcaagaatatcttttcactcatctctaacatgcatgtattatcattacgctatccttgtgttttctttccaattaaaataatatctaggatggttttaattttctcagatgagggagcacagtaaagaattactgaaagaaagaggaacagcagaaaatatacaaggggaggctgcagaaaatctaggttataacccagatctgccactgagtcaatatgtggccctgagcaaaccatttaccttctccaatccccagatttcatatctataaattgaggataattacatttttcctaattttcagagttgggagaatcaagtgagacctacaatgcatgtgaatgagctttgtggcatttttgagcaccctcataatagtcagaaaacattgtgcatttgagagccacagtactgggcacacagtaatagttgtattaaactaaagagcagcctcttggatatttgataatttctaagtcgctggcttttatggtacattaaaaattatatacacttgcatgctgtgcattaattcttttacataacgattaaaaatgtagcatcatgctatgaaaaattaaactcaacactgcaagcataattgtaactctgatagtatgttaacaagtccacatttgtacttacctccctgtggaaagaactgcgagtaaatctctttgaaggtttcttcattaacaacaccactggggcattcctagggaaagtggcagagaagcaatatgagcaaagtgttcataaaactgaattttttttgcacattttgaaacagaactgtctaccatgcaaagctgcaccaagaaaattaaccattcatccattattacaaagggaataaaagcacactataaacttatgtttgttccagttctcacaagaaaaaaaaacgtagatgtaaatatctttgcatattgagtatcaaagtaggtgtaatgtattcagaaacacagtgctgcttttaagaacacatatgtttattataaagtaaaaggaaattgcattatttttcacacagcaagcatgttgcaagatgtttataatatagtctttggtgaatcttggttttgtcctttcaaggttttctgaactcacataatcttcgattcaatggcagaattactctattggcatctctagtggctcaagaagcttcaaccagtaatagatactaatgcttgttaacaggatgtctaggcatacccaagacatggttttgtaacaagtgaccttgggtgagatagaaccccatatttttgaacttccggaaaggagagtctgcaaagaaatggcctggcctgggcttaatagatccccacctttgtccctgggtcaacttgtcaaagaatgatggacattgatcttgggaactacacccatgttggacaactgacctggaggggccacagggcaaggttagccctctgagagtggttttggcatttttgctaataaaaaaaagaaaaaaagaaactttaaagtgtcagaagggggctgccttggtgcagaatataaggtttgagcaagcaaattgtcccccaatctctggaaattcctccattttttggagttataagaaccagtgtggttaagaatttaggcgtagaggccccttgagtggtggagactgacaatcacatgatagcccagaattgaatcatgtgagatattaactgtatggtgatcccttgttatccttggggcattgcttccaggaccaccgcggataccaaaatccatgcacattcaagtcccacacttggcactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgtaagtggagaagtggtaagttctgtttagtctcttttagtagattctcatgaacagtcccatgtgatcagagctcccctgactctagttgtcacagcactcccacgccacctaacgtccacccaggactaagttcactggggaaggatgaatggtgtgctaactccccaacagacctgactttagacatgaatattctgtgtactctaaatttgatactgtttccagcatctttatcaatcacctatggtagtatttaaaacatcacttaacccttaaaatcattgttccctcactaataaacttactttctttattccagtgagtcagttactcaactgtaatgtgcttcacctgcagaattttctattttctcatttgttgttttgaaaggtaggacctttgatacataaacagtgttaacagtttcaatgtgaatttgtgtttacagagcttctcgatatggttttatcccatttgttaatgatgagcttaggtaggcaaaatagctgcattcacagaggcagaactggaggtgctgagtggcaaagcactttgttacacactaagccagtggggaagctggaatgtgggcttggaactctccaggtcatgacaaggtttcgtattagatgacccctgtggaaataatgatgacctcaaggacctaagagaattggagtaaagaaaaaaacaaccaaaaacaaatgagcaagcaagcaagcaagtgaactgtgatggttgattttatgtgtttaacttctctgggccatagtgtccaagtgtttggtcaagcattattctggatagttctgtaagggtgtttttgagatttattacattgatgcaaaattgcggcttttgctattactttcaatacatttaagctggtagactttaagtaaagcagattgccctccacaatgtgagggggcctcattgaatcagtttaaggcctgaacagaacaaagacggaccttcccagagaaagagtgttcttcagacatcatctgtaatattggcttcccttgttcaccagcaccctgcctttggacttgaactgtaactgttttctgaggctccagcttgccagaccccttcattagatatcaagctggccaaggctccacaaagtgtgaaccaatatcttaataagtctctttatactcacacatcctattagttccatttctctgaaggaccctaatacataaatgaattaacaaccaatagctacaactccaaaggtggtatgtatacagctaatctctcaaacattttgactatctatctagctgacaccaatggacccattttaagactaaacactttgcagttagaccctctcacacatggaaattgtgatttattggctatttaatgctaagccagttgcttgggatagtaaggagagagtaaatacctggctctctgccatcaggtggcaagcttgtgcaaagttagagctggaaagttgcctgggagttaaaagttgatgctgataaaggaagaggacttcaagcaaagggacctctgcatcaacaaatttgttagctgccttcagtctctagatatatttgatagatataatgtgaaatgaatttgtaaactgactatctgatatgcatgtgttttatgtttaatcacatatctgtgtcagaggaaaccttttctctgccaaatgaaaactactggccaagtttcagggtggaaagtctcaccagataaatttgtttttatccaccttatattcattacattagtttacatctctacaaacacatactgtatgcctattattccaggagtcttctaggaactgggactgctacaataaaccagtcaaaggtcttcccatcatggaacctctatccaactagaagaataaagactgtctttgttcaggctcctttaacaaaatgccatagactaggcagcttataaacaatagaaatttatttctcatagtactggaggctaggaagtctaagaccataggattagcagattcagtgcttgatgaggccacattcctggttcatagatggcatcttctagctgtgttcccacatagtggaaggggcgagctagctctgtggggtcttttataaaaggacacttatctaattcatgaagtctctgtccacctgatctaatcatctcccaaaggccccacctcctaatactatcacattgggggttaggatttcaacatatgagttctaaagggacacaaacattcagaccatagcaaagaccaataactaaatattaaaaaatcaaatccaagaatgatgatcttttatttattcccagagattttttattgaaactagtgcatttttttaaaccttcaggtgagaaaaagatgctagtgatttacaagatggtatacattctgtaactttttcttcacctcttctgtgcagtgatctctccataaaagtggtctctctacttctctatcaagaatgaatttggccaggctgcatgtgcagcaaagtgtaaaacataaacaatgtgctgtattagttaactcttgctgctgtaaaattaggccttcaaatgtcccttaatcaaaatgcttgggaacagaagtgtcttggattttagattttttgggatttggaatattcacattacactcagcagttgtgttagttcatttccacactgctataaagaactgcccaagtctgggtaatttataaaggaaagaggttaattgactcacaggtcagcatccctgggaaggcctcaggaaacttacaatcatggtggaaggcaaaggagaaggaaggcaccttcttcacaaggcagcaagaaaggagaagtgctgagtgaaaggcaggagccccttataaaaccatcataactcatgagaactcacccacttatcacgagaacagcatgggggaactgcctccatgattcaattactccacctgctctctcccttgacacctggggattatggggattacaattcaagatgagatttgggtagggcacaaagcataaccacatcaccagttgaacatacctaacctgaaaatctgaaatactccaatgagcatttactttgaatgccattttgtctctcaaaaagttttggattttacagtattttgcttttttggatgagggatagtcaacctgtataacacagttaaaaaccacgtagtatatttcttattcacataacaatcttgggtgagtgtacagatcagctgatggttcttctagggacagaggctaatgaagatttggtgactttaacatatggcgccaacagtctctgtgactgtgtcatccagaaggaggaaaagaacgctgaaaagagtacatggaaactttttatgggccaggtcttaaagtggtatacatcatttctattctcattttttttgttgttagagatcacttaatgtgtctaccccaaacaaaataagaagtctggtatggccagaaagaagacaagaatgcagatttgtaaagagtttggaatatctatccctgtggcatgtttgaaagatactccaagtgtctgtgttctgaaacagttctcccactgatgctttatttattgatttttattttgtatttttgtaaagatgggatctcactatgttgcccaggctggatttgaattccctgccacaagcaatcctgccttggcctgccaaagtgctgggattacaggtgtgagcccagcctcccactgatgttgtaacatgaagattatcaagtcatttagcagtataaattgtctccatttcccaggtgtcatttttaaagactgtttacttgcttcaagtaaacaagtacaatgaagcttaaatgtttgagcatgaattttttcattagatttttctaaggatccaagaagcagtagggttcctgggtttagggatagtaagaaatgcctcactcatccatcttctgagaatttgctgcaagcttctactaacccttatggttctgtattctattttctaatgaaattttgtctgattattagcaaatgattattccatgaaaatatgccctctatagaaaaaaattaaagaaaatgaaaatcacccataatctgactactgtaagagtatattggtcatttatataagcatatataccgtagaaataaagttttaataagacaaaattatagcattttatgttctttaactttaggaaatatcctgaacattttttacatcatgatttttagtgactgcataataatgcatccattgaacttaccatactgttgcatattgaggcgattttggcatttttgcactacataggaataatgatgtaattaatattctatgcatccttctgtgactgcacttgtggtttcttctttatgactaatcccagaaggagaatcgtaagaccaaccagtttaaaccattgaaagctctttctatgcacagtcatggtgctttccagaaacgctgcatccattcgtgctgccaccgcagctttatgagaaagtctcacaccgagaggagctaccgactagaatcacatgggaattggacacacacacacacacacacacacacaaccccatgaacaaacagcaataatttgcttccctcatgaatccaatcgtcattctgaaaattaccagtggacattgaggcgtttggacaggtccctccgaggcataaagcaatttgcctgtttttcacacagacagggtcgctgtgatggcactcagccggaccacatcaccacaatcacagcggtttattgaggataaaataaacaactccattccttcttatgcagaccattacttttaacactttcatcaaccctgaaaggtgggtattatttagacatgaggacaatgagcttggagagatgaagtcacttgtttgagtcacacaggttttgacagagacatctttttgctcatttattcaataagtagttatttaatgccttctaagtgtcagcaaatagttcatatgccttttactattctgggcactggagatacaggaatgagtttttaaaattccatttcttttttgctcttgtggaatataacatttagtggaatcagactcataactctgactccatgaattgcaatgctatcttgccttctggattattactttttcttctattaggactgaaaacatagtctcctggagagtcatctgtggaaatccttcttctgggaagatgtacacggtgtatttgtacccagaggcacccatcacagctgcgttggagagaggcatgtgcaaagggaagccatttcaatcaaaattgggatcaccgattaaaatttattgtgcattgtagcttgagagatttgaggaaagcaatctttttctttttagaaatctttggttttagtgtaacaagaacctccccaccttcctgtgtgccacatactctttactgtcattgtaaatggctagatagtaatgggctgaggaaaatgttctggtttttaggaccagtcaaatgaactgctccatccagtatttaggagctggaggtctctggttctgctggctggtatacttatctatgatgaccattgcatttctttcattgcctgtgaaacccttcactgtgatatgatcacaacacaataaaagtagaatgaggttttctttgcaatataactgccatagatttgtctgttggtgaagaaacagtcgccttttggggccttactgctgtgttccctgatgagccttttcagtcctctcaggccatgtggggacacatgtgagggtcaagattagttgtagatatgcaatgaatactatgctagtactaatatcaattttaataaggcagtattactattgtaataatcagcataaagtaatactttattggtattgatattttataattattaatgtgatgatgacaatgatgatactgatgatattaagctaatacacatgagcactttttatgttccaacccttgcattaaatgttttacatggattatctcgtgggaatagaaagatgttagtattaactccattttacaaatgaatgaactgtcttagagaggggccactgcattcccaaattagaaaatagcagatctaatctatagatcacagaatcaggaaacttgagagtttaaagcaactttagaggccaggcacggtgggtcatgcctgtaatcccagtactttgggaggccaaggtgggtggatcacctgaaatcagttcgagaccagcttggacaacatggtgaaaccctgtctgtactaaaaatacaaaaattagccaggcgtggtggcacatgcctataatctgaactacccagcaggctgaggcaggagactcacttgaatctgggagatggaggttgcagtgagccgagatcacgccactatactccagcctgggtgacagagcaaaactccatctcaaacaaacaaacaaacaaacaaacataaagcaactttagagacaattcaattcaatgtcctcattttgaaggtgaggggatagagattaaggaggttataggaactgaccatagatacacagggggctgctaagcctgacctcatgtctaggtttcctgaggtctaggactaagctttgatactgcaaatgtcttcgtgtccatacaatagctggtaatttttgtcaggtactatttagaggaatctagtgcagtgcttatattcttgggctctggagttaaatagaaggcctgggttgaacccctactctgccacttgggagctgtgtagcttcaggcaaactgtttaatctaagtctcattgctctcctctgtgaaacggggacaggaattgacctcagagagctgctataagaatgaataagatacacatattatgctattatcctagccctctaccttacacatcatatttggtcatttaatattagctgttagtaccatggtaatagtttaggatttggtaagcagaactccatcacgcaatgagtcactgtaacatcaatgccgatagaccaaggataaatcatatttatcaacgtggttgaatctagaataacacaggtctgaaatgcaatcagcttatgaagtatatatgaattacgctttctattctagtgttataagttgaatcactctatctaatatcatcagaatttaccctaaaagaaaggaatattgtaattgtaaatgatagcagaggagaataaaggccaccatcatggaaataaatgtcagtagaaacccaggagcctcttatttattaatttaaagttttccccagcgatgcttacatggtatgtttgaaatcatcatggaaagtgttgggaagggtgctttggagaaagatccatgtatgcataggaaattgctaagaaacatattttgtgagtgcttcaagagttcttatactttcaccttataaggaaacctttcagcatttcctggaaggttttcagagctctgttgaaatgcatgagaaatagctgcagtggtatgcaaatcacaggtataataacatcatataattataatattgtccactccaataatctttgcccactctattagctgaaatcttctcttcccctaaatcattctgttctgatatgtgtcttctcctcaggatcagaattgttattaaacatttagagacttcttcaggattaaaaaaaagaattacagtaagacatttcataggaaaaaaaaactaaaagtgcttgtgaaatagttatttggggatcctttcatgatacctgtaatgccacatctcttaggcatctgtatatttcaccaactctcacacccatctctggtgctaaggagaacatacaaggtagtctgctcggtctatcagttaaaatagtatttagcatgtagtatgacaattcagagattctctggcattctataattgcaggagaattttcaaaatttaaatgacacaatcctacaacctgtgctgctgatatcaccagattctgtggacttctctgctctctttagagttagtaaatacaaggcagggactaacctttacgatgtttagaatagggaatactaaaaatatttatgctgaatgaataaatcttcagtcagttcttagcttttaataaattagaaaatgaatttgctctgataatgtccttcaaaacttgggcctacatttttagaactcctaagaccaagaccaagatagtcatgggggttccgatatccccatgattgcccacaatgactatgatcgcagaaattaaggggagatggctaggatcaagaaaaacacttcttatttcaacataaaaagcttaacatagtcaaaaattggattctaaaaagctcatttaaaaattataggattaacctttcagttttcaaagcagaaaagctgatcattaagaactagagctggctataaatttctgttctaatatgcccaggtgtttgaactcctagcaactcatttattccttcttagtctaaatgttctcatctgatataacaggtaagtaatactaacatcacaggtaagcaaaagaaatgcaaactaaaatagacaatggatgaaagaaacccaaccaattttaaaaactgaatatactcaacatgttggatattttcttgtttccaaaatctgcattaactgcctcttccatttcctgaacacacttctggggtcaaagtggttaaataggcactgcagattaaaaaaagaaacagccaatggtgggaaaaggctgacctagatactatccttggaaaaggaatgagagctgggtgaccaagattcaattcagctgcaaggatgtgggcacattctgagccccacgagttctcagggtcacccaggatgaagcagaaatccaaggtactaggcaaaggttctctccccttcagttctgccctctaaccatatggaagaaggaaatcacatgagatttacagccaaaaaaaaaaaaaaaaactggctcaagtttcagctctactactaatgaagaaataattgaaaagttctgctttgagtcttagtctttaaaaatgcaggaaacaatagcatcttatagtaaagaaatgagaactaattggcattatgtatataaagattctagcataatactaaacattctacaaattgtacttatttttactattatctcttcaagtaacttaagttggttctgcaaaaagagattttccaaattttgtaggaaaaggcttcctgggattgggcccaattcctgaatctttagtggaatgcatgtagaattgtttgatttacggagacttttaaaaggattttcccaactttatccagaagacagtgtccattttgtcagggtcttttaaaaattatgatgtagtgaaattctataggcacccaaaaccatttagtggaaaaaaaagacaatggtgccctgggacaaagcctatgtatcagttttctattgctgcataaaaaatgaccataaacttagtaactctaaacaacacaaatgtatcatctcacacttctgtgggataaaagagtctgacatggcttagctgtgtgctctgctcagtctcccacttaaactggctatggttctcatctgggccttgcagtcctcttccaagctcactgaggttgttggtagaattcagcttctgtggttgtagggcccaggtccctgtaaccttttggctgtttactgggggcttctctctcagcttcattccatcttcaaaccagcaaagcaaaggcctgttgagtccttctcacactctgattctctctgacttcccctttggtaaaggactcgtgtgattagatcaagcccacaaagatcatctctgtatcttaaggtcaactgccctgagactttaattatatctgcaaaatctcatcacagtagtaccttgcttagtatttgattggataaccaagagacagggatcttgagtggctgcatttagatatctattaatacctcccacagcctgcttcttctgaacatcagttcattttggttttcatagcagtttttgtttaacaacagtcttttttttacaattatactcacaagtgtatccaccacaactcgcaactatatttcttggcacctgccatagtttaatgcgatttgaaaagactatattctgtcaaggctttagaatcagcagtgtaaagaccagctgtgaggccaaaattcaatattttttatgagtgctaagaatagtatcccatatgctgagtgttccccgtctagagtatgtctgcctatatccagagcagaaataaatttttttagattttactaattgattagatcactttcaagttggcatgatatcagcctaataatattgaccaaaaaaaaaaataccgagtaaagaattctacttaaaagaaacacgcagtgtttcaatcagaaagaataaaataaaatacagcaggtactccatatcgcagctgcagcatgcacagattcaactaactgtggcttgagaatacttgaaaaaataaaaattaaaaataaataaaaaataaggcaggtgcagtggctcgcgcctgtaatcccagaactttgggaggctgaagtgggcggatcacctgaggtcaggagttggagaccatcctggccaacatggtgaaaccccgtctgtactaaaaatacaaaaaattagccctgcatggtggtgcatgcctgtagtcctggctactccggaggctgagacagaagaattgcttgagcccgggaggcagaggttgcagtgagccgagatcatgccattgcactccagcctgggagacagagcgagactccatctcaataaataaataaataaacaaacaatatgaatgaaaaacaatataacaactatttacacagcatttccatgtattagttattataagtaatctagagatgatttaaagtacatgggaggatgtataggttatatgtaaatactacaccatttcatataacgagacttaagtatccccagattttggtatccatgggggagggttctgaacccagtccctcaagaatacagagagatgactgcatggagatgatggtatacacatatgttcatatatatatacatggttgtataaagcctttttattccctgaagatttaaaaaaatctattctctcccagtctgatttctgtcacctactaaattggctagattctggccccttgataacttcatttagactatgatttctggactccttatgtgagattacacattttcctcatgtgtaagccattttttattgatcttttttgttacttatagtcaaaagcattctaacataagctacaaccttcttgtccttgtattacacctttctacagaaagagaaaataaaaatgagttgagtttacaggttgctgacaagtttggtgaaatgtctgctggagaaagaggtgtcgtctatagattacggtggtgggtgcgcatatgcaggtccagatttttggagaacgtcttttaaagtctatccaaagacactttgagaaagcataggaattgggggtgaataaaactcactttttttttttttgagacagaatctcgctctgccgcccaggctggagtgcagtgctgcgatctcggctcactgcaagctccacctcctgggttcaagtgattctcccgccttggccttcctagtagctgggactacaggcacccgccaccaagctcagctaatttttttgtatttttagtagagacggggtttcaccgtgttagccaggatggtctcgatctcctgacctcgtgatccagccagcttggcctcccaaagtgctgggattacaggtgtgagccactgtgcccagctgaataaaactaaatttaatgatcattcgtggtctgctgggcactgagccatgtggtgtaggagatacatgttctcattaaatccctgagaagtagaaaaggtagatgttttaccacacaatgtttaagaaatgagcacagggaggtttaaagaactttcccaaggtcagtgggactgggatttgaacttgagtttgactgcaaatctttcacatcttcctaagcttgaaaggtgagtgcacctgcggggggaaaagttaactaaggggtaacttttatcccaatgtctttcaatcctattaatcactaaaacacaaagtattcgttatttgttcaacacgtattcatataccaagcacttgactacgcacaggagcgtaacggttaatcaacaagcatggccctcatccaaaggagcttactacggaggaagcagtcagtattcaaatactgacatcaataaatatattgaaaccctcagggcaaagcagcatgaaaacttgaattgttttttacaaataaattgaaatgtcccaggtgaggggttggaggataggacctcaagttgtctggtcatctgctttggtgaggcaggttcaggacaggtcagattcagctctaaatacattttatacattttattatacattttgttccctttctctctctctttctttcttcttttttttttcttccgagtttcgctcttgtctcccaggctggaatacaatggcacaatctcggctcactgcaacctccatctcctaggttcaagcgattcttcagcctcagcctcctgaatagctgggattacaggcgcccgccacgacgcccggctaattttttgtatttttagtggagacgaggtttcaccatgctaatctcgaactcctgacctcaggtgatccgtccacttcagcctctcaaagtgctggcattacaggcgtcagccaccacacccggcccctttccctttcttattgccattctgagaaaatactagtttgtccctcttgcacaagtttttccctcagtgagctaccatttccaggagcagccctgagtctctgaagttaaagaaaaaaaaaaaaagtttagtctgcttaattaagttcttgttgcaaaactttcttagttattactctcagttgtagcttttggaatctaacagcccctcgcttatgagccactcatatcacttactagcctggaactttgaataagttactaaacttcttcaagctggattttatcatcactcatttatgcaggacgtatttttgaaattgttgcaattgttgcaaatacttgagaagtttccaccctcctttgccttctcctagtgcttcttcagaggctatgaagggaacaattatcaagggtcacggtagctgcctaaaaggaacctgtgtctagtacttcagtgcttccgagctctcaggtgggacagtaaagcctctgtctcctctccatgccaggcaaaatgacccaaaaggaaactcccgggcctgttgactctgagcaagctggggcagaacgcttccgagggctctctggagctcagacggcgctcagcgtgagttggaccaaacattcttagggttgtatcatcataatgaggcacaagggggcagtagtgtcctccatgatagctagaaaagcgatttccagttctttttcttaagggattgttcttttcctaagcttggtgcctgtctgggtaaatttctttcaagaaggctatttcctttttatgaacggtgacagcctcattcctacattagataatttaaaaaattaactatttctgggaatggggcccagagactctgatctccattttggatattacatttggtgtacgtcagtctgaattcacaatcacttttttggcagttgggccacctttaatttagtcaccaaaaacttgtagatcttagaaaacaaataagcaagacaacgccactaaagttccaaagcttgagtctgaaaaccttctgaaattgttaagtgtatgtgggctctggagtcaaagctgcttgagcctgctttgctgtttaacaggggaacattttaaacctttaagatgaaaataatgatactaccctatctggaggttattatgaggcttaaataaagataacccatgcacaatgtctagcgtcgtgcctggatgtataaacacccagtacacattccccatggaggaaattatttctacaatgatgctcgttctgaacctgttagcttttgtcatgttttcatgtaatatgggatattatgtttatccttgttaaataccatctgcttatttaatttcagaggattttcagaatatcacaccagtgttccacttccttagttattactctcagttttgtagcttttagaatctaacagccccttccttatgagccactcatatcacttactagcctggaactttgaataagttactaaacttcttcaagctggattttatcataattaattaatgcaggacatgtttttgaaagcatattatatgtcagagagtgtaagaagaaatggagctaaaacaatcaagacagatgaagtccctcctggagtttgatgactatcagagaagtcacacataaaacaaagttctgtgtaaataaccattcagttacagttgcgataagtgctacaaaccaagtatggaaggtctaatttatagggaagacttccctgaggatgtgacatttaaagagggacctgaaggataagtaaaaactagcaggagatattgctggggaagaggcaaaggaaccctgtgtacaaaaacctgtgatgtgatcaatgactaaagagatggcaaatgtgcctggggagtgtggtctgagacaaggttggttaatttggggcctgctagttacattaagaatcaaggtctttgccattcacaagataggtatcatatacctgtttttcagagctctggagagaattaagagatgatttacatcaagtgcccagcacaatcccaatcgcattctaaacactcagcatccctctcttttctgtttactctaccagagttgaatttttacctctggtttattatttattcaatacgtaattatttagcgtctactgtgtatcaggctctctgttataaactgaacaaacaaaaggggaaaagcagacatggtcttgcctttatagaatctctccactgatgagctattatgttctttgtgcatatgaatttatttcaagggaacaatagtttcaacatatatggcgattaaaatcttgtgctcctatctccaaaaattaaaagtaaataaaagcaagcaagcaagcacacagaataaactcacattgccatggattgcaatgtaaataactcaagattatgaacttgtatgtaggagttacttctgcatgtttctttgcttttgctaatgattaataataacgagtccaggccagacacagtggttcatgcctgtaatcccagcactttggaaaaacaaggcaggaggattgcttgaggccaggagtccaaggccatcctgggcaatatagtgagactcagtttcttaaaaaaaaaaaaaaaaaaaaaagttagccaggagtggtggcatacaccttttgtcctagctactcaggaggctgaggtgggaggattgcttgagcccaagagtttgaggctgcagtgagctatgattgctgctgcactctagcctgggcaacagagagagactgtcttcaaaataaataattaaaaagaataatgatgattgtttttacagtatattcttgcacatggtacagatggttagaataaatctctgtactactgaaagtgctaataagtctccattatattatcttaggggctaagtatccttcaggagggcagaaagactcccagctattaggtgtatctaaaccccacatggctatgtttaccctgaaactgaggcagtctaactcttattcctttctgtttacctgttttaatatattgcatatttatctatttaatatatacaaatgttgtcttctgataaaggtccagaaattccaggcatataaaagagcttcaaatcccaacaattctaccacattcacttttcatttccatctgcacatttttcatttttagagctcatggatagtctagacatttatttgcaaatattatgaaggtattatttcaatcagcaagggattctcttcaaaacttatatgagcttatggtaacaattcttattctctctagtgaggcataaagctaaaagttttatgtttttgccccgtaaggaaggaaaaacaatgcatgtttttgtttttttctagtatctcacagatattttcatttcctggtttaccagttgttaaccttaatgcatcccagaaggagattaatatttggatttaaataataggagctctactttcggtttcttgttatctttgctgggagatgagaagtctggggtggtttattctctgtacaacctctcaaaattgtactatagaccaacatactgaggaagataaggagcaatccctccagtacttacaatgctcatatgaaaatagatgattttctgaaagaattagaatgctatattttattaattgtttctagttagactttaattccaacaactaatatctccttctttaagaatgatttccctaattctaccgttaggaaattatttaattctaccataattatgttttatttttttccattttatgccactgtgccaggcactgtccattttatgacatatttgtgtcagcttaacaaatctagctcatcagttcagaatcaacaatgaaccaaatattactgtagattatatgttaatacataggagcacagttattacatgtataactatttctccattttgtgaccattatagggtaattatgaatagatgaaggcatgattactttagatcaaaacacaggcaaaaaaaatggatcttctttggggaaatgttttatgctatagactgaaagtgtgtgtggcctccaaattcatatgttgaaacctaatctccattatgatcatattgggaggcggggtctttgggaggtgtgttagttcattctcaggctgctataaagaactgttcaagaatgggtaatttataaagaaaagaggtttaattgactcatagttccacagggctatagacgcctcagaaaacttagggcagaaagggaagaaaacatgtccttcttcacatggcagcagaaaggagaagtgccaggtgaagggggaaagccccttataaaaccatcagctcttgtgagaactcactcactatcatgagaatagcatgggggcaactgcccccatgattcaattacctcccactggatccttcccagaacacatggggattatgggaactacaattcaagatgagatttgggaagggacagaaagcctaactgtatcaggaggtgattaggtcataagacttaagtttttaatgaataggattaatgttcttataaaagaggcccaaagagctgctgtgcctcctccgccaagccctagtgacataatggaaatatggtcttccatgaaccaggaagagggactttaccagtaaccaaatctgtcagcacctcgatcctggacttcccatcctccagaaatgtaagaaataaatttctgttgtctataagccacccagtttatggtaatttgtgacagtggaggttgtagattacagagaaaaagtggaggttgtagattgcagagatgaattagtgtagtttatgaaaccatgaagtttgacgttcctgagggatatcccagagaagttgggaaaccagtaattagaaaggagtttggaactcaggtcagaggtcaaagcttacagctatcagtttgtgctcctttagcacataggtatagagatctcccaaggaaaatacctaatgaagaaaaccagggagctgaatgcacagccttggtgggaagctacatttaaaaaacaggaatgggataagcagtccatgaagaccaggataaagtagacagagaggtacaaggagaagccgtagattatatcaaaggaaccaaggaagaagaggcattcaagtaactcaaggcctccactcccaaactcagcagagacttcagttaggtccagagaagtcacaggagaaagtgttagtagcatagactctgaaacaggctgtgtaggcttgcatctagtctccactactcacactagctgtgtttcttaaattctttgtgccagtttattaatttacttgtgcctcacttgccttatctgtaaaatgggactaatagtatacttaccccatagagttaatacaaccataacattgaccaatatttgtagaaccttaaattcttaactcatagttagaattaaatatatttattgaatttaaatcaagcaattcatagatgtcaagattggaaactattcagtggatttgcaaatgaaatgtagttttgacacacacacaaatcagtacaaggaaaactggggaaatctgaataagatcagtggattacatcaatgtgagtaacctgatttaatattgtactgcagctttacaagatgatactactgggggaaatggtacctggtgacctccttggactatttcttactattgcatggcaacctattgttatctcaaaataacaagtttaatttaaaaatattggtagccatggaaaataaaggtggtcttgacctatgaaagaacaatttaaatgacatggtagaggcagaagccaagagttaagaaataaatgcagatgaggggttatatagactgaacttagacagctgttttaggaattttatgtaagagtataagaatgagacttgccaatagttagagagagctgtgtgtgcatgtaaaagttgttgttattgctgatttggaatgagtatgtcttctaatgcattttttaagggtgaatgagacttgactagcattacaatatgtaaggaggcagctaggaaaagaggaagagacagggaggaggaggaagggagggaggcagataaattataaagaggaatcaagatatcataggaagtgggattgaaaacactagggaaatggaacattcttttcttttatacaggaagaataagtcagcaaataaataccaaacaggtgccagctatacactggacttccttctaggagttaattaagcactgtggttttgattgaataatacagatcaaattcctctgtcccgtgagaaaatgagacagttctgtaggtacatttactgctggaatcagaagagctgtaaggatgtataggcatgttactgtaaatagatgaggagacactagatcatgaaaaagagacaagattatcaagctgagtgtaaaaattgctaattagtagtgactctcatatctggatttttgtttggttttccccagcaagtaatagagaagtggaagacaaatcattctctgaccctagagttcggtgaccccagagccatataggtatgtgacaggttggaaactggcttctcaaaatatattgataacctaatctctggaacctaccttacaagtcccccctgccccacaaccccccccccccacacaaaaaagaaatgaaaacaaaaaaaatttcaggtataattagtttaaggatctctataaggagagattatcctggattatccaagtgggccttttaggctatcccaattgtccttacaggagagaggcagagagatgtgacatacatacagaggaggaagggatatgatgatggaccagagagacatttgaagatgttgaccttgaaaattacagtggtgcagccacaagccaaggaatggtgacagctgccagaagaggaaggaaaagattctcccccagaatttctcaagggagcatggccctgctaacaccttgattttggctcagtgatattaatttcagactttcgacctctagacagtaagagagtaaatttttgttgttttaagcctttcagtttgtagtatgttgctacagctgcattaggaaactaatacatgcatgattgtaggacatggataaggaagtagggatgttcaagggtatttcaggaaatcaaccatatagtgcagattagtatggaacttgtgagactaagaagggctggtgatcccaaaggtcttgcttgcagaatcaatgagcagaatgtagtgagattgagggcttaagacagttgaatggatataaggttgtggtcaaaagggtgagaccatcatttaggatgtcaggaattaagtagtttcaggtaataataaagtccaagtgatatccatcagagtgaaaagtggaatggaaaagaaaataatggcatttaaagagtcaaaaaacactgaagctcaggtgagtggctggtaggcaggtcaactccatggatattactgtcaagccaatgaacaaagattttaaagtcagcgatcaaagtctggaatgagtatgatacagaaactctcccagtaataacatgagacgccctgattctggttctctgtgactcagctctgttagacaattttcttacttcaggaactgccaataccccatttaacatgatgctggtgaggcttttaatcccatttccatgggccacagggctaggtcaaatgatgcaggcttttccaggaacagttctccatcccccaggccaaaatgattggttcagtgtcatgtgactaaaactagttcctgccttgctggagttattagcacggagaaaaggtgagtaaaagagacagcatcctgatacactgttggagccttgatccagccatgcctgatgctgtaagtattcctatcttagatatgtgagtcaataaacctttaacttaagatactttgaatgggtttttgttacatgtactcaaaaatatcctaatttataccagaatagtattattttcttgctctttgttctttacagggtggctacaaaggaatcaatgtagcctcgtagtttctctggatggtatttcagtgctttgggagataaccaccacataaatgagagagttcctatttttctttgttattgttttactatctaaccccagctacaagaaaggatatattggtttattttacaaactttatcttcacaatcagaaggatgtgagctgtagagcattattttaaagaccagtcggaagatgaaatggtgcaaaaaataaaaaaagaagaaaaccaaattaatctgcaaacacattagaattttcaagatttaatttcactgttatttttgcccatttgaagcaaatctattcactagatctctattaaatccctactgtaagccaggtacaaataaatgagatgaacaatttgaactgatttcaagttgcaaagtaacaattatatgatgaatttctttgagaagcaaatgttggtatatcagtccattttcccgctgctgataaagacatacccaagactgggaagaaaaagaggtttaattggacgtacagttccacatggctggggaggcctcagaatcatggcaggaggcagaaggcacttcttacatggtggcagcaagagaaaatgaggaagatgaaagaatgaaacctgataaaaccatcagatctcatgagacttattcgctaccacaagaacagtatggggaaaaccaccccatgattcaaattatctcccattgggtccctcctacaacatgtgcaaattatgggagtataattcaagatgagatttgggtggggacacagagccaaaccatatcattcaatccctggcccctccaaatctcatgtcctcacatttcaaaaccaatcatgccttcctaacagtcccccaaagttttaattcatttcagaattaatccgaaagtccacagtccaaagtctcatctgaggaaaggcaagtcccttctgcctatgagcctgtaaaatcacaagcaagctagttacttcctagatacaatgggagtacaggtattaggtaaatatagccattccaaatgggagaaattggccaaaacaaaggggtcacagggcccttgcaagtccaaaatccagcagggcagtcaaattttaaagctccaaaatgatgtccttttattccaggtgtcacatccaggtcatgctgatgcaagaggtgggtttccatggtcttgggaagctctgcccctgtggctttgcagggtacagcctctctccaggctgctttcacaggctggcactgagtgtctgcagcctttccaggtacatggtgccagctgtaggtggatctacctacagctggggtctggaggatggtggccctcttctcacagctccactaagtggtgtcccagtagggactctgtgtaggggctccaaccccacatatcccttctgcactgccctagtagatgttctccatgagagccctgcctctgcagcaaacttctgcctggacatccaggcatttccatacatcttctgaaatctagacagaggttcccaaacccaaattcttgtcttctgtgcaggctcaacaccacatggaagctgccagggcttagggcttgcaccctctgaagccttggcccaagctctacattggccctttcagccacagctggagcagctgggatgcagggcaccaagtccctagactacacacagcatggggaccctgggctcttcccaacgaaaccatttttttcctcctatacctctgagtctgtgatgggagaggctgctgcaaaggtctctgacacaccctggagacactttccccattgtcttgggaattaacattcagctcctcattacttatgcaaatatatgcagctgacttgaatttctgctcagaaaatgggattttctttcctacagcattgtcaggctgcaaattttccaaacttttatgctctgcttcccttttaaaatggaatgcttttaacagcacccaagtcacctcttgaatgcattgcttcttagaaatttcttctgccagataccctaaatcatctctctcaagctcaaagttccacaaatctctgcagcagaagcaaaatgccacaagtctctttgttaaaacataacaagagtcacctttgctctagttcccaacaagttcctcatctccttctgagaacacctcagactggaccttattgtccatatcactattagcattttgggcaaagccattcaacaagtctctagggatctccaaacttttccacattttcctgtcatcttctgagccctccaagctgttccaacctctgcctgttacccagttcctacgtcacttccacattttcaggtatcttttcagcaacatcccacttctggtaccaatttactgtattagtcagttttcacactactgataaagacatacctgagactgggaagaaaaagaggtttagttggacttaacagttccacatggctggggaggcctcagaatcatggtgggaggtgaaagtcacttcttacatggcagcagcaagagaaaatgaggaagatgcaaaagtagaaacccctgataaaactgtcagatcttgtgagacttattcactaccatgagaactatatggggaaccacacccattatttaaattagctcccactgggtcgctcccacaacacatggaaattatcggagtacaattcaagatgagatttgggtggagacacagagccatagaatatcagttggtaacacactgaactagggctctaccattaagtaagcacacagaaatacaaagttcaaataaggataaacagggaatataaaaactattctgcttaataggaattcagatacctcttaattttttatattatctagtaattaagagtgagtgatattattgggaaaccataaaggatccatttcatcagcactgttttttgtttggttggttggttgttttgagcccttacatatatctggcactgggtaggctctgagaatacaatggaaaaatggcaggcctggttcctgcccctaccctttggttcctgtcagggtattctctgaggcatcacagggtttatccagttcactatttagtaaatgataaaactcacattcaaacactagtgtcctaaaacaatataagtctgtctctcctaaatgagctcattatttttgttttagccacctgagagtagagtttctaattcctatctagcttgctgttcaaataactgataattaatcccagaacattagtttgcttgaattgaaaaggcacatcacgttcaagtgcctcgtttttaatataaggcaaactgaggcaaagaatgttaaatgttcttcacagaacaagaggagaggccacttttcaccctcagcctagtgtttatctgactaaaccacaccgtgaaagataacagtctatgaagacaaaaattacaaggtttagaatcctctttccttctccctcagacaactgggaaataatattctttaataaagttgtggttattggactagcacagtagccaaatttaggatgacttatttattcttaaaggttgggactttcattctggaagtacttttaactgttaaagattcctctttccctttccttcttctttccttgcctccctcatttttcctacattccctccttttttttcttgtattatttcattacacaaatgatcatttattccatacaaagttatggaatgtgtagggtgggtatgctggatgcaagggatataaaattggcacagcatctttcttgctgtcagttggctcacaatcgagtggaaagcaaagatgcattcagtgaatcattacaaaacactgtgatgtgtgcattacggttcatcacagaaggagttttggacccttactgggaagaggagaattaagagctgggtgactgcgaaagatttgcaggggagaaaatggctggagagattttgaaataagggaagggcattcccccattccagcatgcagaactaccacttgcaaaggcaaatacgattttctgcagatcctcccctaaccccaccccagaaactggggatatatatcattgggaagagatacagtttaatagagaggaaacactgttggaccactctcccaacacctgtttctcaaatgtgaggcagggctagccaagcatcccacatcaagagaagattaggatgggggaagaggtagaagtcaggcaggaagaatgtgaaagacaagtaccagtctatgaggctggactggtaggtaggaccaatacttaattttctaaatgcatgccactttccctacagatcaatgactgctagcacttccctacttgcttttctttggatttttttttctttttttttttttttgctactgcatgcttctttgactactgctgccaaccttgggaatggattgatgacccacttgcttctcaaacagctctgcagataccacttaggaagctggtgttcgtgttctcagactgaggaggagcagtgtccaaaatcaattacctgggatggtgtgtgctgatccacctagcaatgaactcagatctttggagcttgtttataacacgtacattgctcaacataccctggttctaagatcagtgatgctatttcagagcacaatggggataatacattttacatttatttaatgtgaattttggaaaaatttgattaaaaatgccacctttggcttttttaaataaagaaaatcacaataaaggatagaaagtaattaatgatttttaaaactggttaaccatatacaaaaatcaactcaagatgtattaaagactgacattgtaagtccccaatctataaaactcctaagaccttggtggaaggatctccatttcttggtgggaatgtaacttggtgcagccactgtggagagcaacatggagatttctcaaaggactaaaaatagaattacaatttgacccaggaataccattactgggtatatacccagaggaaaataaattgttctactaaaaagacacatgcactcatacgtttatcacagcactattcacaatagcaaagacgtggaatcaacctaggtacccatcaatggtgaattgggtaaagaaaatgtacatatacagcatgcaatattcacagccataaaaaggaatggaatcatatcctttgcagcaacgtggatgcagctggaggacattaccctacgtaaactcacacaggaacagaaaaccaaatactgcatgtactcacttatacatgagagttaaggcttgggaacacatggacataaagatgagaacaagagacactaggaactccaaaagaaggagggagaaaagaggacaaggactgaaagactttctattgggtactatgctcagtgtctaggtgttgggatcaatagaagcctaaacctcagcaacacgcaattatacccttgcaacaaacctgcacatgtaccccctgaatctaaaataaaaataaaagccaaagaggcaagttattttagtgattttaaattttctttattatagtcttctatatttttccatatttctataatgagcatagtgttgtagttagcaatagatggaaactttatcagaaaaagaagaaaatcatcacaaccatcaacaaacttacctgggtaatttctgtcctgttctcttacgaaagttgcaaaaataaaaaagacaatttcttgctcatttagaatgtacactgtgctttataatacatatggccactaccaatttcttgcaagtgttttttttagactctgggaatatagtggatgggttgagagaaaaggtaccatttgttaaagagaaaacagtattagactagaaattggggtaggatacagttctttatctttatcaatgatatagccttgaacaactcccttaacatcatagcatgtgttttgttaacgtaagacgggcccgataaagtatctcccatctgccagacaggatgactggaaagaagtataaatattttgtaagctgtaaggtgctctatctatgtaagttgtttttgaggcgattattcttagtaataaataaaatactgcttagaaactcaacgtggacagtcttggtctagggacctacttattgtgcaattggcaaaggggcccttctgagatgatgcataggcagacagtttagatacaaataactagaaatggtcaaactgtaatatctgtcctttcccaccttttacatctcaaaaagcagttttcatgtttcatagtaataagggcttttacatctataaattccctttcaaacgcctacatctctcaacaaatttgctaccaccgcaatttattttttaggtggttttattcagatgaaaatagtttatttgagcactttggagttgctgtttgagaatgctatatgagtattaaatactgtattatatttctgatgctctttaaagattttcttttctgtctgcaatttaattttgtttttagaggttttttctcctcctcttctcatattgattttatttttggcgctattaaaaagtgctcaatgaacaacctttttggaatgaatgtaaataagtctgtatctctatgtatatgaatatttttaagtgcattaacttttagtataagacttatgtaatgattaatttgctcctcaaattctaattcttattcaatcaataaccattgttcacaattttaaatacattttattgatttttgaacatttaggtcattagtagtaagatcaatgttagccataattcacctttaaatttccaatgttcaggttattaaaaatcatttgcttttatttccagcataatttatttttaattgaaattcttccttgtgataatttttctttttaaagcaaccatgtcttctttataactgtctgagtgtccaattacattttcttacttatgaaggtttttaatatctaatcatatcttatgtaatcagtgggctattgtgtaaagtaatagttctttttctcccttatttatagggattttactacacacttccttcctccctatttttttctttcctgaacacctttcacctggtattgtgatagttcatttacttgtatgtattgctcactagatggtaaactctgcggggaaaggaatttttttgcatgtcatgttcgctacatcattcctgcatttagcatatgcctaacaaatagtagtctagcaagtattttaaatggattaattaaggaactctaaactacaagacaccaaggaacagatgttcagataaatacataaagatataatctacatgacaatgaaaaggttatgttaaaagtaaaaccctgaagtgcattagaataaatatttaaaaatactatccaggacatataacagttgctatttttctatttaatgaggtatattttggatcccagtcagcaaacaactctctctaccaaaagtagctgactatagcccagcctgtctttgcagttcatggcagaagaagagcagagaacacacagggctcaggtccagagttagctcagagaaaacagaaaatccaatctcagcacagtaaacatgtaggaattcagcatctcatagaggttactgaaagcaaagaatcaaaaataataaatggttataaatagtccatgctctcagagaactttgagtgcataaacaaaacctataaatcttcagcaaatgaaaataaggctctggttaataaaacaaaacaaaacagaaatggcctagtgtaattgttaagaagaggagaaaaacataccccaaagaattcagtatgtagttggtgaattcagagcaaacaaaaatggaaaattacaccttctcagccacacaaaagaaaagacttctaaggatttaaattaagagtatcacagtgaggaggaaggaggagttgattattgggcaaaatattttgcctctatcaaggcttgagctcatgagtaaaaggtgtgcgaggcctccttccatagtgtgcattcagtccttctcaaagaatccattcatttccacattaaattctcaagtaaagaaatcaatcaaacaaaaaaactcccacatgtgttattatagtttctacctggactatgtggacatgtcctgtctgtctatagcagttgcaatgctattgcccagagtggaaaaaaagaaaaagaaaaggagcttcccataaggtttatttctacatgttaaaaactctattgctaaaaccctaccacactagcttaggaatcacatttttagtaaatgtcaccaacattttaaaaatttggggccatttttatcctctaagaaatctcgaagagatccagaattcatgtatttaaaatttgtctcatataacaaataaaagaaaaataaagacaatgaacagcttcacagacaaaaaaagaaagatactccaggtaaagccaaaacaatacaactttctaaaaataatatagaaaaacagctttatgacttgaaaataacactagccattagttattagtattagattgcaaaaatagctacaaatgtctctccttcctgaatctatgcccttgggcagtccacttccatatctatgctgggcttggccctgtgcctgtctttgaccaatcacaaattgctgcaatcaaaggcctcgaaagcactaggtcattgaggtttgccctcttttgctgctctcaggacatcatcttaccactgccatatgaaaaagcacaggttagttttcctggctgccaacctgccaactattagatatttatgagacatcatcctagatcatccaggctccagctgatgtagctcagatattagctgagccatcaaaagcagaactgtaaatcatgagctgaatcaatgtttgttgtatttagttcctatatatgggaagggtttgttatacagcaaaagctaactttgtagaaattggtacctagaaacggggtgctattataactaaacttaaaacacagtcatgtatcacttaatgatggagatactttctgagaaataggtcattaggtgacttccattttgtgcaaatataagaaagtatacttacacaaacctagatggtacaccctagtacacatctaggctatatggtataaacttttgcttctagactgcaaacttgtactgcatgtaactgtaactgaacactataggtagttgtcacaaaatggtaagtatttgtgtatttatacgtatctaaacataggaaaagtacaataaaaatgtgatataaacaataaaaaatggtatccttgcacttaccatgaatgggaattgctctgggtgaatcaacaaatgaatagtgagtgaatgtgaaggcctaggacattgctgtacactactgtagaatttataagtaggctaccctaaatttatttaaaaaatatatatcttcaataacaaatttaactttaggttactgtgacttttcaaactttacaaacattttaatttttaaaagcatttaaactcttgtaataacacagcttaaaacacattgtacagttgtacaaaaatattttctttcctcaattttataagctttcttaatttttaattttttttttttactttttaaacttttttgttaaaaaccataacataaacaccctcattggcctaggcctacacagaatcaggatccctattatgactgtcttccacttccacatcttgtcccactggaagaccttctagggaaataacttattcaaaagaagttgacaaagccataagaaaactgatttagctggctggaaaaagggaaaaatggtcacctgcagtaagttggagaatagacaacatgtcaaatgaacctacagaccttgacaagttggtttgtaggcagaattttccaagtgccatttggattattttgttgcctaagataaaggaagaaaagagagagagagagattagccaaagaaagatggcttattttgcaagtagaattcagaaagaataaggagggacaagaacttgctaggttggaaaataaatctattgctcatccccaatcttctgtttctaaaatattctaaaataaagtatgttctggggccagatgaaaagacatgttacatatacaaggcaaactataaagatgacagtagttttttcatcataaataatgcaagttagaagacaatagaacaaaatctttccaaatactgaaagaataaaaatatcaaactaaaattccttatccagtaaagatatatttcaaaaacaaagacaaaatagacatttttagatgtcaacagctgaaagacataacttactacaagaaatgttgaaaaaagtcattcaagcagcagaaaactgatgtcagtagaagcctagttctacacaaagaatgaagagcaatgaaagtagtaatcacatgagtaaataaaatatttgtctttattatttaaatatccttaagagataaccaattatttaaagcaaaaataatgatgatttgagtttttatcatatataaacataaaatgtatgaaaccaatcatacaaaaaccaggaacaaagaaatggaagtacactcttgtaagatattttttttgcacatgaagaaatataatatcatttaatgacagactgtgaaaagttaaagatgtttgctataaaccctaaagcaaacgctaaaataaaacaatcaaactttataattaatgtgatgcttaagtttatatgttaagtttatatgttaacttggctgggacataatatctagatatttggtcatactctattctagctgttctctgaaggtattcttgaatgggattaacatctaaatctttgagtaaagtagactgccttccataatatgagagttcatccaatcaattgaaagccttaagaaacagattgacctctcctgagagagaagaaattctgccataaactgtctttggatgtgaaccacaacaattgccaccccaccagtctaccctgcccatattggacctactaacctcacagacatgtaaatcagttccttaaaataaacttctatatatacatctatacacgttattgattgtttctctggagaaggctgactaatactactaataaaaatcaagatagaggctgggtgcaatggctcacgcctataatcccagcactttgagaagctgaggcaggcggatcatctgaagtcaggagtttgagaccagcctggccaacatggtgaaactctgtctctactaaaaatacaaaaattagctgagtgtggtggagggcacctgtaatcccagctacttgggaggctgaggcaggagaattgcttgaacccgggggcagaggttgcagtgaaccgagattgcactccagcctgggcaacagaacgagactccatctcaaaaaaacaaaaacaaaacaaaacccaaagcaaacaacaacaacaaaaacaaatagcaatgcaacatatgtaaacccaaccatatcaataattatctcatatgccaatgggataaatgccacaaataaaaggcaatgattgtcagactgataaaaagcaagagctaattatatgctaccaacctactttaaatatagagataaaaatatgttaaaaggctgaaaacattaaaccactctgtgttagtcaaaagacagttgaagtggcaaacattagacaaaatagatttcaaagcaaaaatattgtccataatgaagatatttcttaataaattcaagagcacagaataatcttaaatatttatagatctaataatatagattaaacatatatgaagcaaaatatgataaaattacaaagagaaatagatgcatcaaaatagagtcagaaatttcaacttccttatcacaatgtttgatagaattttagaaataaattcagtggtttataggacacttgagcagtactatccaccaacttgaatgaaataacccaaatgttgttgaggatgtaaacaaactaaaactttcatgtacatctaatgaaaagaaaaactagtagaagtatctcatagaatagttggcaatatcttaaaaagttaaaaaatataccaaccctgtgatttagacattgaaaatatacacatttacccaggggaaaagatagtaagtatttatacaaaaacctgtacatgaatgttaacagcagcattatttgtaacatctttaaactagaatcgtcctaaatgtccatttacaggtgaatggataaacaaattgttgtatatacctataatggaatagtactcagcaacacaaagaaatgaacaacagtgatacataaaacaacatgaatgaatctcaaaggattaagactaagtgaaacattcatattcttattttataaaattttagaaactgcaaattagtcatgctgagacaatgtagatcaatggctgtctgtgaatgagattggcaaggaagggaactaaggaaagattagaaacacaagggaatatttaacagtgatggatgttttattattttgattgtattgatgatttcatgaatgggtatattcatatgtaaaaactttcaaggtgtatactttaaagatgtgtggtttactgcagcagtccccaacctttgtggcaccagggaccagttttgtggaagacactttttccacggatggggtgggatgcttttgggatgattcaaccacattacatttatggtgtacttgatttctcttattattacattgtaatatataatgaaataattacacaactcaccataatgtagaatcagtgggagccctgagcttgttttcctgcaactagatgatcccatctgagggtgatgggagatagtgacagatcatcaggtactagattctcataaggagcacacaacctagatccctcatgatatggtttggctgtgtccccacccaaatctcatcttgaactgtaactcccacaattcccatgtgttgtgggagggacccagtgggaggtaattgagtcatgggagtgaatctttctcatgttgttctcataatagtgaataagtctcatgagatctgatggttttaaaaagtagatttcccctgcacaaagtctctctctttgcctgttgtcatccatgtaagacgtaacttgctcctccttgccttctgccatgattgtgaggcctccccacccatgtggaagtgtgagcccattaaacctctttttcttcccagtctcgggtatatctttatcagcaatgtgaagatggactgatacacctcacatgagcagttcacagtagggttcatgctcctatgagaatctaatgctgctgctgatttgataggagtcggagctcaggcagtaatgtgagcaattggaagtggctataaatacagctgaagctttgcttgcttgctggccactcacctcctgctgggtggcctggttcccagcaagctgtagaccagtatcagtcagttgtggcccaggagttggggacccctggcttactgtatgttaattatacctcaataaacttaataaaattatgtactctataattccacttatataaaagtaaatacagccaatagtaaactatattgtttatggatgcaaactttggatattgaactgtaaatcaaagcaaagtagggataaccttgaaagttaggatactgaataactctaagatggatggaaagatttatcattgggaataacatctggattctagtgaagttctatttctcgatctctgtgtgggttatgcgatatttgcctaacaaaaaattgtttaagctgcacctgtattcatgttgcataggcatataagtgtggcttagggcattcagagcagtctttacatgatctaacaacacaacactgacctgcacattctctaagtgggacatctgagtttcatttctttgaaatgttctttaaaatttttgagaaaaaggtgttaacaattctgccacaaagattaagactggatttggttaatcttcaggaaagcagaaacttgtttgtaactacttgaaaatccctttctggtatttgagctttgtgggacttttgcagtaatttacagcttgattttaaccgggttgaactttaatttaaccagttgattgtggcaagttatgataaacagcatgaaaaagaaaaaacaatttctttcataactgataatgtacacatgctgaggagaaagtgggactctgaattcttttggtgatcagccattaaatcataaagaagaggtgtcttctttatgggaagatagaatagaagcaagatcttcttaggtatgtgatcctgggcagatgactttattatacttctgtgaaatggtgcctcagcaaccacttatattttggctgtgaaaatcaagtggctataaatgtattaaaatacatccgaagcctatagccctaaataatgtagcaactctcaagttgcttttattaatatcagttttcatagttttcattctaatttgtcatagttttcattctaatttgtttgctgatttcttatcattattctcagtaatgcagtctttctctgaatcatagttagtattcttgacccagtgactcaagtcagcatgtctaatttcttaaatctgaattgtctgcaagatttcatcttgattctatcttttgggttgcgctcaagccagtgtaccaatttcacaatatctgctaattggtacattgttgcctaccatctttaaaatagcctgctctataactctagtttttttaaggaaatcaaaacaatgccattattataaaagttaatgacatagcaataacagatctattgtcacagtgcttatccactgcaagtgtccaatatatcttactaatttttcagagtttagtatttccactgttgaagttctttttatttttcataagatggttcacaatggacacagggctcaacattacagaagaaattgtatcagtctttaacatcttatccataaataatggcattgtaaatacacacacacacgtcaattataattgatataccctcatgcaaaagcattattaaaatctacaatattgatataataataccacctacatcattgagttctgaaaattcaatgagtgcatacatgcagaaagtttaaaataaagactaggaaaatgtgtcggatgttttcttctttgatcttaaagacagagataaaatgtacatattttcttagtcgaaatctaacttagtatatatctattaagttaatatttactctgactctcaaacattctgaatctcttagtggccaatcacttgtctaatgccacccagttggaaggagctaaaattgcttttttgttttttatttgcttgtttgttttttgagacagggtctcactctgttgcccgggctggagtgcgctggtgtgatcacagaactggtttttaaccacgttttgggtaataatacttcacaagaatgctggatgattaaatgaagtagtgtgtgtaatgtgttggctcattggacagaacactgggtgctgagggatcatataggagtctgactctgcctaactcttcaccttgtttaataataacactctggaaagctcatttatctatacatgcctttaaaagcagacaaagcatttttattgcttttttttttttttttaccacttccatggcctaaaagaatcacttttgttttgaagactctaatttgcagagtaaacaaaaaagatggaaataactaagaaataaaacctccaaaagtttaggaccccaaataaaaatcatttgaaatgcataaaaatgcataaaataggtacaatgaatagtaatagatggaaaaaaacagattccatcataggtttgttacttgaatactaaactttttcaataattagctgttataatatccgtgttcaaaaacacagcactcagtgcagatcaaaattctaaaataaacaacagttactttccattttctcttgagtaagttatgagattacctctattgctctaatctagaagatatgaaaacaggccctccggccctaactgactctgtgttgtgtaataatatttcccttcaccaacctttacaatgaatataaaaattcaatttcagacctacaagctagaaagggctcaagtgtcaccagacttttctaaggggatattttctgtttttgtctacatttatatttgactcatttagtggagggaggtaataggatttttctatctgctatagaagctatttcagaagtacacagatataaggtcagaaaatatattttaaaatcacaaaagaaaacaaaatgatatgttggttttgaaccctagggtctttcaacattataatcaagcatgcctgagaatatctagctgtgacttcagagagaataatagtacacccttgagtctactgcaacagtcttccatggtatggtaggaaaagaatcctaggatagctcccaagacttacaagatacacacctcctggtgtgtatgccctgcataatctctgggaatgtgaatttaatggattttcctctgcgattaagtaaagctatgtacactatacagttgatcttaagacagagaatttatccaggtgggtgcgacttaatcacatgagacctttaaaagtagagcattttatctggctgactgaagaagaggaaaccagaaacggaaagcaggaaaagaatttgcatcactcttgttggtttaaaggtagaggggatagagagcaaggaaagtgtgcagtactccaggagctaagagcagtccctggctgtgggtcggcagggaattaggaaactcagtaatatagccacagtcaactgaaatttgccaggaagaatgatcttagacgtggattttcctccaaagtctgcagaaaagaactcagctttgcctatacctggattttggttttgcagtttctttggaagataacacagtgatggtgtgctggacttgacctacacaattgttagctagtaaatcagtgtttttagcctctaagttggtgataatttgctacgcagcaatagaaaacaaattcacatggcttggatcctacccaaatagtttttattatttcattaattcatttgttcatctctatatttatttctgaacacattcattaagtgcctatcatgtcccttctctaatcgttatgacgagtttttaacatacaagacaattttatgaccctcaccttaaagactatgttatcaggatactggaatgtaacattatttactgttcctaaacattatcaaatacacatactgcagatactctgaaagttgtgaaagctttaaataattcagtatgcagttttgtggctcatatagaaagcttgatgggccttgtgaaaagctgtaggcattgcccatgtctaaaggataaaagcggtagatgacagtactccatgtaattattttggctgtctcacaggcttattgaaatttccttggagtgacatcaacaagatggctatctagaagctcctagcatccttctttctaccacacacacacacacagacacacacatacacacacacacacagacacacaaaaaagctatgaataatcaagtactttttgaccaaaataactaaaggagagctctagagaatagcaaagaagcagcagaaatcctgtagagcatagaaacccaggatggctgcatagggaagggaaaaagatacctcgcctccgccactccatcccctcagttggaatcagctcagaaccagggaggactcctttctgcagggaaaaataaagacgaccccagcaattctgattgccactgcagacacctgcagcctttgttatcagagactcctacagtcctcacaagctctaaactcaactgagagagctccctagagtcacatgctgagctatattcagagaaggtgacaacactgtgccctggcctcacttctccccactgccccctgtcccctatcctattgcctgtactgctactgcactacaccattttggaaccagagacactactagagtgcatcctgctctgggggtgaaacccattgcaccaccctccattcctgagagtttgctgctattgcaacatgcacactccatagtgtgccatacctgagccaagctgctactgtgccctactccctagggccaatctactatatagctgctccatcctgcccattctagttgctggggcacctccacttaaggccaacatccagtgatggtctgccagcaggggatttcagatattctgcacaccagagctatcaactgcacctcaccttctagcaccacaggtgaggcagcttcctgaacctagagactctaataactctggcataccagactagttgtttgccccagcatcacagctgatacagtgccctgctccccaggcatctggcagccccactaacccacatagccatgctttctggagctgagaagacatagtacctgaagtcccaggaaatcacaggagctgtgccactaccatctccaggacaaagagccacagttcctgcatacctgtaactggactaacctccacccatctgagctggtgagatgtcccacctttccagggaatgaagtcattgctgtgctgctccaccaccctcaatcccaggcccaagccacagtggtgccttgccattcctgagtacttgctgttactgtacccaggctcacagagcctgggcttctgtcatgtcccaccatcccagggtccaaactccacactatgtgctatctcatccctcagatcctgagctgcttctatgtcctgttggttccaggatctgaattgtagctgtgcactgttccgtgaggatttagtctctggaaaatcccttcttctccagagctgcaccagtgctgtaccctgtttcccagggtcagaacatagctatattacagcctcctgggtttaagctgctagagtttgtctcaaagcaatagatcccagctttttgggagaactgcatccacttgtgcctgggaatgtgaacctgtgtctcaagtcccaggtgttacagtaatttcacaggacgccccactgtgggggaagataagaacagaatgattcccaaagttcttgccataataacatacatagccaccattattgccacaaattcctgtagcctagaccaccaaggtaccaaggtatgtcagtcatcactgacactgatcacaattgaagaagctgcatacagactgtatcactgggcccacacagaactacagccactgcactttgcccaaccagtaccctcaggcccaccttcggtgaaagcctacaaaagctactctgtaaagtttggaagaggtaactacacaatcagatgtgcagacatcaatgcaggaacacaagaaacacagaaaacaaggaaacatgacatcaccaaaggagcacaataattctccagtaactgaccccaatgaaatggaaatttacaaattgcctgaagaggaattcataataatattctttattattaacaagacacaagagaatacacataggcgattcaatgaaatcaggaatataattcattatctgaatgagaaattcaacagagagatataataaaaaagaacagaaatcttatagctagtgaatttaatcaataaaataaagtttaaaaatacaatagaaagcttcaatagcagactagagcaaacaaaggaaagattctgtgaacttgaagataggtcatttgtgacttggtctgacttagaggaaacaaaagaaaaaggaatgaaaaagagtgaagatattctttgggacttatgggatatcattaagcaaataaatatttgcattatgagattttcaggacaagagattaaaaaagggacaaaaatgcttatttaataaaatagtggctgacaatttcccattttgggagagatatggacattcagattcacttagctccaaggtccccaaacatatataacccaaagaggttctctcaaaggcacattatagtaaaactgtcaaaacttaaagacaaagaattttaaaagcagcaagagaaaacatcaagtcacatacaagggaatctccattagaatatatcagtagatttctcaacagaaactttgcagacaaggagacaattggatgatatattcaacatgctgaaagaaaaacctttcagctatggctgttatacccggcagagctatccctcagaaataaaagaggcataaaatattatccagacaagcaaaagctaaatccatcaccactagacccatcctaaaagaagtgcttaaggaagtttttcaaaaaaaaaaaaagaaaagaaaaaaggcattataattactgtcataagtatatatgcaactataaaactcactagtggaagaaaatgcatagtcaagttcagaatactccagtactataatggtggtatgtaaattatacatctgcttagtatgaagattaaaagtcaaaatggtcaaaataactacagcactacagctacaataagttgttaagaaatatacaatatgaaaagatgtgtgacatcaaaaacataagttatagggggtggagagtaaaagtctagagtttttgtatgtgatagaagttaagctgttatcagcttaaaatagctgattaaaactataagatgttttatgtaagcctcatggtaactgcaaaacaaaaaacatggcagatatacaaacaataaaaagaaaggaataaaagcttaatactacagaaaattataccacaatgatagacaacaagagaggaagaaaggatcgacagagctacaaaacaactggaaaagaaataataaaatgacagtaagtccttacctctaaatgataacctagaatgtaaatagattcaatcctttaataaaaagatggagtggctgaatggataaagatacaatccaattacatgccgcttgtaagagacccataaaagacacatgtaactaaaagagagcaagagtggctacagttatgtttgataaatcagacttcaattaaaaaaactatcagaagagacaaagaaggtaattatttaatgatatagtggtctgacaatcaagaagacttaaaaattgcatatacatattgcatatatatatgctatatatatgctatatatatgctatatatgctatatatatgctatatatatgctatatatgctatatatatgctatatatatgctatatatatatgctacatatatgctatacatatgctacatatatgctatatatatgctacatatatgctatatatatgctatatatatatgcaatatatatatgcaatatatatatatgcacacacacacacgtctccaacattggaacacctgaatacacaatgtaaatagttataaacctgaagagcaaaatagaaatacaataatagtagggaactttaatactcttttcagtaatgaatagatcaaccagatagaaaataaatgaggatataatggactcaaattgcacttttgaccaaatggaccaaacagacatatacaaaactgtccatctaatagctgcagaatacacaacttttttcacacatggaacattctccaagatagaccatattttaggccacaaaacaaggttttaaaaatttaagaatatcgaaatcatacctagtattgtttcagaccacagtagaaattagtaaccaagggaatcttgaaaaattaacaaaaaacgttgttgtggaaattaaacaacatgcttaaacaacaaatgggttgaagaataaatcaaaagagaaattttaaaaatatcttgaagccgagcgtggtggctcacgcctgtaatccggcagtttgggaggccgaggcgggcggaccacgaggtcaggaggatcaagaccaccctggctaacacagtgaaaccccgtctctactaaaaatacaaaaaatttgccgggcgtggtggcaggcacctgtagtcccagctgctcaggaggctgaggcaggagaatggcgtgaatctgggaggcgtagcatgcagtgagcagagatcgctccactgcactccagcctgggctacagagtgagactctgcctcaaaaaaaaaaaaaaaaaaaaaaaatcttgagataaatgacaatgaaattacaacataccaaaacctatgggatgcagccaaaccatttctaagaggaaaatttattgcaataaatgcctacattaaaaaaagaagaaagatctcaaatagatagtctaacattatacctaaaggaactagaaaaagaagaagctacaccaacgattagcagaaggaaaggaataataaaaatcagaagtgaaataaataaaatagccacgtgcagtggctcacacctattattgcagtgggtcatacctataattctagtactttgggaggctaaggtgggtggaatgccctgagctcaggagttcaagaccagcctggggaacatggcaaaacctcatctttaccaaaaaaaaaaaaaaaaaaaaaaaaaaaaaaaaaaaaattagctgggtgtggtgtcatgtgcctgtagtcccagctacttgggagattgaggttgggaggatcacttgagcctgggaggtggaggctgccgtaagctgagattgtgttgcttcactccagcctgggcaacagagtgggaccctatctcaatgaaagagaaagaaagagagaaagagagggagagagagagagaaagagagagagagagagagagagagaggaaggaaggaaggaaggaaggaaggaaagaaggaaggaaggacggaaaatagagaacagaaaaaccatagaaagaatcgagaatatatttttgaaaacaacaaattcaatatggaggccatttgatttatgagaaaaaggaggaaattctaggaccatgctgaatgggctctgatgttgagtctgccattttctagctgtgtgactctaagcaagttatttaatatctaagccttatctataaactaaggatagtgattacttaattcccaaagtagttgtgatgatcaaatgatataaattcagtaaaatattaaaagtgatggggtaggatagtaactcaagtgtaatagtgatagtgatactaacggtgactaatattagtgagcaaacatgatgttcccaagactgcacaaattattttccatgctttatctctcatttcctatggtaagtgcatcagataggtactgttattttacccattttgcagataaaaaccaaggcacacagtaatccagtaatttgctcatggtcatgtaaataaatttgaacccaatttcttgttagcactctcttctccttataatgttctttttatcccttcagtaaaaataagtaaaaatattaatgtgtatgttttaccacactgctgtactttagcatacagtagacattgtgaacattttaaggtcataggctgaatttccttcatagaaaagaaagattactttctttcatatatatattctatatagctctttttcttctaaaaccacatatctacaaccagcttggaatatccttacctaatatctttgtttctttttctcctccttctcaaaatctttttctctactagctctttcttcattgtttattaaacatttcttgcccttaagaaagcaccttttgttatactctctttctacttgattgggtgtgtattaatcagtacatactaggttgctagtgtcagaaacttaatgtaacttaggaaaagtagaaatgtatttatttacggaataaaacaattaacaagaagagcaggtctatagttggataacggaaacaactggatcaaaatatatgaaagtcatagggaatggaaacctcatctctacctttttctgatactcgatttaattttctctgattgcagaccagcttcctctgtgtggtggtaaatctaactgacacaattctagagcctcataaatgaacagtttcttctaatggcaggagcagagtcgtgattctggttccaaaatttcccaagaagggttctgattggtctgatttgggtctgtatcccacatgcttgctgacaagtaggtagtggtaggtcaggtaaaatccatttagctcctactaaaggcatgaggatggagaatgtaggcaaaaggaagttttcagacatcaggaaaatactaagcagaaaatatcatagatgcttccttttttttttttttttttttttttttttttaaagaggcagggtctttctgtgttgctcagactgctcttgaactcctggagtaaagagatcttcccacctgggattcccaaagtgctagtattacaggaataagccactgcacctttctgccttctcctcttaaagttgctgttccctttaatactcttcttctattgactaaattttgccaagctttgtaactgttctgagaaatttctttgaatattatacttgtcatctgttatctcttcaccagatatttttctgtctttttttcttatatagaatttgaggtttgggttggatatttgaatatagcaatatttgaccatatttatgagaaattacttgaaactttctgctacattcagcatagagaagagttggtttataaagcatctggcttattggagaaattttttccttcagtttctttcccaataaatgccatttctgctaactcttgattagactacaaactgatctctgtaatacacagacaagtcctataaatctgtctttaatggttctcattcaattaaagtcttttcattgcttaaatctttctttcctcagagtagtagaaaaatttcaaactgaacggatttcaatttcatctccttacctggttcaatagtggtattttgaggttggctggctgctcaaaagaaatttttgttcttgaagtcatgtaaatgtactagggtatgtttaatgttgaccatatgagtcagtttttcctaaggcatgctgtgctttgacaatatatagattcaaatcatctactatttcaagaatttgaaatactactatttctgaattatgtttttaaataataattctgttccattatttctagtttcctttgggggggctttctttaatatattctttgcctgttctacattttaattactttttccgtctaataactttttaaaaatgagtttctttattgtcactttgttttgttgccttttaagtcctctatgcaccttgctgtatttttccttccttatatgtcttctaattttgcctttaccttttttgagttttatttcttttacttttatttcctgagatctgctagtttccatttcatgcatattgctgtttcaccatctctcttgtgtgcttttttatttctgtactatgttcttgctttacagaggcaactacttcaatgcattttactcatttgttttaaaatttatcacaaaatatttgaccatagttttcatctattttgttgcaacttgttttcttttcaggatactttgccatttgaccttcttatttttttttaatttattttccattatattattatatagatcctgttcttccttgcttcttgttttactgcttattatcaaaggacatgaattttccccactagctatttgtaagcagtttatatagggtgggttgggaggtaaaacagaaccatgcttagggctaaaaattactcaatatgaactaaaaatctgaaaaacctgaaaatactcactataagaaaacaatttcaaaagatattaaatatctgtaaaaagttttcaaagatatctggtttggtgagttagtgtttccaattatgttagtaagcagcagaactgggttttgaaacaaggggtatggatgtggattctgcaatgtttacccaggtataagaccaaatgaaactagcaagttaaacataaacaaaatgacagagccaattgatatccaactagtaacattcatttaatctgataaattctgctgttttgctgaaatgaaattgcccttcataaggtgaatatagatgagaattctgctccatatggaataaactcacatcattgtgagtttatatggttctgtcatcactgtgggctgtgtgctgagttaattctctcaccattttttaaacaactgtgaaaccttcctttgtagagttgcctttatgacatttatgacatttggccaagtcatttagaccaagtatgtcatttacacttatactttggtcatttagaccaaatatgtcatttacacgtaatgttagtcttctttattttctcattagctcatgtcagtataaatggaactacttgacaccaacataaacattagtgcaaagacaagtgtgaagaccctgtaatcacatggcacttttcagaaatatgaggtcatccagtgattctacaagaggggttggcaaactgcagcttgtaggccacatccagtttacccctatttccataagacccatgagttgagaatagtttttacaattttaattgttaaaaaaaaagaatatgcctcagagacatgtgtacttctcaaagtctaaaatacttagtatctggccctttaaaagaaaaaggctgctgatccctgtcctagaatatacttatgtcatttttaaaaatggttattatgagatgaaagcacaaaatgaaaagcatcttttagaaagcttcaggatacttgggaatactttttcagaaagcagggaagaaaacacatttctacctactgaaaaatgtgctcagtaactcatccccaatatttgtgagttaaaagcacaaacagaccattacgtgggagaggcacaacaattcttggcactaagattaaatagaaatcactcccaggattgtcataaagaagacactatggaagataacgatgtcttcactggcgcacctacagtacatctaacaagtttcacagggcccttttaaaagacaatttaaaatatagcctgatgacaacattcctaaaaacaatgtagtgaaggcagttttagagaacttgagagtatgggtcagagattttcatttctattaatctgactccatgcaaggctagattgtagactctggacatatgaagaaactggaaacccttaggacaaatctcttttttggtaaaactgttgaatatatgagtagataccctgctacacaactaaaggtcagcttttctatgttgccagctgaattcatcatacccatttcacattatcattacagaagagcgtgacaatgcaaaattctggagataagatcaaacatatgaataacaacatttaaggatgccatgaaggctatttgagacaggtcctctgtccatgtgatgcaaaaatgacagaggacacatcagacataatttgtcacaacccaatgacattcatgtcagtaggtgctgagatgtaatctgtcatgttttagttagaggaaactgtatgtagctcttttgatggattgataagtagattcatccatccttatactttgaaagaacataattattcataattatttgcatgtagttatttataaacacaaccctttacattttatcagtaaatgtcaagagttgcctcactcggtgcactttatgctagtttagctaatttgcttaaattgggatgcccagagcccaagtatatcctcttgtgtcctgggaaacccacccttgccctttgttaaaggagtagcagttccatacgctggatggattgaggaatttcccattattgattaaaggtcaactatactctgggttctattaaataggtacacatgaaattaattaagatgaactagttaagacaggttcaccatttggagccactctcccccatctccacctcatcatgcaaatcttttttatggaagctctattcagcttagatatttaaatcagctctcagtaacttatctaccataaccgtttacttagttgtcctctctcactctcagcaaaatcaatgagctaaaaagattaggaaccatcattctttgtatttccagcacccagcccagtgatggtgtgaggacacatctgttactccacaccttctattctcagcacaccttaagctaaaacaacttgtgtttctggcacagctatcggagactttcagaggtgacaaactcatgctcatttatttagttgcctaatttctccagtgtcagtaataatctatattcttagcaaatcattgggaattggaaaccactctgacagattaaggccaggaaattttttaaagaagaaatgcaagaactggaaattacatatgtgaccttgtgccattcagcctgtgaatggtgtgtgggcttaaaaggttgttagggttgggatggtagaatatgtagagcttttggagaatgttttttgttactgttgtttgacctacttcattcccttcagactccgagaggtcataacacacgatataaagtgcaaggttaataatggagaatgtcgcattcaggagtttctctgcctagatgtggaattctggcttataggctatttctttctgtgtgtctctttctcttcactcttgaaataagttaagaaattctcaacgactggaatatatgttttccaccttttctggccatcaactgcgttatcaggatgaatgtcaattactgtcattctggaagtcatagggtgcattatcctgttttcctattataggggtatttgagtaataaacttactctcttgtaatatcatataaaattttattttaactgacatctaaaagcacgaaacctcttaaagtttggcttgccccatggaggtgaatgcagctgcagctcatctcaggagtctgcccttatatgaactgcttgttcttacctttctactcctcagcatgttgaaactcagaccacactcctaaatgagacatccaaaggctccggcctgctggagtgctgacaagcatgctgtttagggcaggtactcagaggcaaagtcagagaaacatgatctcttcagcagcacgtttttgcacatgaaacctgtgtaaactcagcatgactcactcaggccaaggtgagcactctgatgtctgtgaacgactgcagcaacttggcaactggggccagtgtgcttccctgtagcactcagcagagacagttcaggacttgaaacaattttcctcattgctgttgtcactggagaacaaaaactgcaaaagcgagccattgttcacactgaaagtcattttgtggagaaaatgagaggcttggaccagtctttttgtcctttattgtatcgtcccctctggcatccatttatgggtctgatttcatttctattttcattttgagacttttctctatgacctcaggtcagagacaatatcaaaggcaatatgttttagtgggtttatttgtctgagtcaacagaaaaagagagagggaagggaaatggaagagtacagggcaggggggaggaaggggggagagagagagagagacagagagagaccaactgagactaaagctatgtctgtatgaaaagatgactatagttggatctggaattctgaatttgcaactaacactgatgccatttacaatgtaacaatcagctttagtcttccatgtgaatgtagatattatatcatcatctcataacattttattccatatacatggtcaccaagatgaacagaaagagttagatctgggtggtgagaactgggagaaaaccagccatgagaataagatggattgtcttttgtcacagaaatagcaaatttttaagtgtatttgaaatgataaatacttttttttaaccttttgtaacatttcacaaaacttttaaatcaaatttcaactggaactttggtctgctttccttaaatgcagctgatttcttgctaaattccattgcatttgatgccttcagggatttgggaagttagcgtactgggacagaggcattgatgatacatatgacgtggacaaaggaaatgaactcagcatatgtgggaagtatagcaagtgttcacttgtggccagtgtcaccaaaaatgccaccaaggtaactcaacatagtcaaagtaatgaggcagaattgttcttcagttaacttgttaatagggaaactttttataagcctaactggtctagtgatatttggtccagttctcaaacctatcttagaggcttccctgtctcatttccatagggaaaaaactccctatccaattattaaatggataaataagtgcttaaaacgtgaaaaatagggaaattcatgctatttgaactagtttttgcttaagtatgatatggccatggcaccaaacttcagtgtgtatttaggatcaccttagatgcatgttgaaactatacacatacagcctaagctaatcctaatgaacctgcttaagttggtcttgagtgtggcctaggaatttcattgtaaacaagtatcccagatgattctgatgcacatagatgcattctgatgtgtgtgtgcatgtgtgtgtgtgtgtgtgtgtgtgcgcgcgcgcacgcgtgcacgccagaggggagataagggaaagatttcaagttaaaaatgggtttgggttactttgtgaaagaagttgaatggcatgctaaggagtttgtgtttttaaataaagaacaaacgtgatcatatctgtactttgagaagtataactctggtgacaggacggtttgaagagggaggggagaggagtcaagaagactagttaagaagtttttcaaaagatgagcacttccgccaaattcttcatcacacattgtacaggtaataaataagacatggttcctttcatgaagttgcttatgatcttgtaggaaaagattcaatgaatgaggcagagatggagaagtcagagaagtggcttggatgggcaggttggggctggacagattttgcagagctttaagaagcaaaggaagagcagattcccagaaaagaatataccctaagagacaggccactaaattaaatgacagtttgatggtgccacttttttcccccactggggtgtctggactctacagacttacataaatgagcagtgagaaaatgtaagtacagattattgattacttttggggacatgtttgcgtaaagaaagacagagctaaaatagcagcttgaagatatcaaaggctaaggaaaggcaatttttgtgttgttttgcttttgttgtgagtctgttgttctttataggggagattggaatatatttccaggaaaaagggaaagaaaatccaaaacctagagaagtgaatgttggtggggcaaagagaaagagagcaggaatgagaccaggagggcaggtgaggtgaagaattcggtattgggaaggaagagaccagaaagctgaagaggatggatggctacacgatacctttgagactgggaggaagcagcaggagaaagagataaagaacaatgagagatatgagttagacactgggatatgagttagacactagtcacatttcaccaagggaagagtccaagcttaaacatatttttcatgtcgcaatatgcttagggaaagctggcccctttccgaatcccggaggatgaacacgtgattgatctaaacacggcatagctatcccattctcttctattggagttcggtttggggatgggcaagtgaccaactttaggccaaatattaaggagatttcttctgagggtacttctgggaagtatttgcttcatgatatatacatttcctcccttgaacttgatagtataaaggcataatgcttgggatgagggaaccatcttggaaccatgaggtgcaaacttaaggacctaagttaaatactaaggataggggaggagaagaaatctgagtctaatgataaccttgagacagtgtggtatctctgggactgcgtacctccaatttcttgtttgtgtgtgagtgtgtgtgtgtgtgtgtgtaatcaaacaataaagaatatatgtatgttctttcttgtttaaatcacaactattttaattttgtgatatttctgttaaaagtatatgtaagtgatgttggaaaaattggtctccatctttttattaaagaggtagtcatgtgcccagaaggatggaggcccacctgtgatttagggttgggatgtgtggaaaatacctgaagctaccattgaagatactgagaatggcaggaagctaatgaaataaatcaaagaaaggcagcataaacagacctcaaataaagtaggactggatgtggacagaatgactttgcaacattgccaaacctcaacaaaggggcaaaaaaggatagagtccttgttgaggagggtttaaaattggataccagaacacagcatcaacccaaagtcaaaggcacaaaggtgtcattgaggggagcaagggcagatttaaatgttttatgaaggagcaaaatcaggattaggattggatagtgcttggacaactcatacaatatgtttttgcctcagttttgtcattgctaaaaagtaaaattaacagctagtgcttaggtttttgtgagggtaaaatgggataatgtataatttattttacatggtatctaacatatttttaagaactcaacaaatgtggtaataattagatcctgaacttctgtcaaagccaggcaggggggcactaaagaagctcacacaacagaaataatgtcaaatataagtgcgacatatatatttttaaaatcagcaagatgtataaacaattctcactattaatactagtaagtttcttcaaagttgaacttaggaaacaggaaaaaattggcacagaacatcctgtgtatcttaccaagataaattccaaataaattgcctgctggcagtacccattaattatttgccgacaatttttcagccagcacatgcttttttatttagctggtccagcaagtcactgcagttgtagttgttcatcttgtcacaggactgggtagaaagccaaatgcagaggtatgagctgccaagtaacccactatctgtgcagctgtggggaggaaccagaaaacctcaagacttcttgctgcttccattttcctagttttttttctctagaacctcatccacatcgtatggtgctgggaagggtcccacagcgtcagtgtcttctatgagtttgttaaaaatgcagactcccaggtcccatcccaggagaactgaaacagaatttgccttttgataagatgtccagatgatttgtttgcacattaatgtttgagaaccactgatatttaggacttatctgaagccacctcacaggataggcagagaatcgctgtttcacccaaaggccctctcatttccttgtcatcccttcatgatgctggatgtggggttcttaagtgagacctcatcttcactaaatctctcattgctgtgcccactgaagccagccttcagttaccagggagcattgccttagaccactttaaccagagagcaacaagctcaaggaaattgtatgaactcaggtgctagacgttcctgggtttattctaggctctgcctcatattagttgacctgggacaaattaactcaactctgtgattgcacctctccctccaagcaagagcctctgcagccctttttcgtaactgttgacccttttctgatggccatcacaggtgggaccaagggagtacactaggggatattagaggaggatccctaatacaagattggccaataagctttgcttcctaggacatctggatttggaaatcagaatccactagttgcctttctcagtgtttgagcaaagaagaattataggacgacctggagaaattatttctcagcaatgggctcagagatacagaaaaaaacaaagacaatatggctgtagaaatatcagtcttcatttctgatagttttctaattttggatcctgctgtctactgaagtctgcattctgcttctgggttccatccctttattcatctaataatttatctctctctctcgcccacactaaattaaattccttaaatccacacagtcctgacaaagcaataagctttaatgaatggtagttaaaatgattattattgctactactggctgatcaacttaatcattattattgtaatgcctcctatatcagctgttttttcattcaaacatagtcactgataattgatcctcaaaatggtaagaaaaccaatcatctgaatcactaggaaaaataaggaaatactattttcatatatgtttatgtattcactattgcattgatgttcaaataattaatttaaaatagaatgatgtctaccataattatagagcacagtggcagctgtcatttaagagcacattttaggcctgaacccctgcaccactgagggaaggaattgtctcagccttcaagcctatcgtgtcccatgttattactcagatatcacaggagacctaactgacatcaggaaggtaaactcagtgacccaggaaacaaaactgttaagttataaaatgatgttaagaatccttgattccacttgctgctgtgggtctcatataatatactcccctccaagcccacagagccttatctcagctggcagcgatctggaaacctacctgttacattaatcaaaacatcttactggaatgctaacttcttgcaaagttccagctcttttcatcaaaaccaattatgtatgaaatgttagacattgtccagtggaagatatatattatcaatattaatgataaaaatcacaactaacatttagacggtagcatgtatcacacccctttgaaaaacgcaacagtattttcagctagtcatcattttctacggttttgtagtgagacatgtgagacttttaagaggtcaaataactttctcaaggttcccagtttgcctgttgcaaattacacttctctgacacatatggatagctctgtccagtgaacactcttagaaacctttaagtaggctgggagtggtagctcatgtctgtaatcccagcacttttggaggccaaggtggatggatcatctgaggtcaggagttcaagaccagcctggccaacatggcgaaactccgtctctactaaaaaaaaatacaaaaattagtcaggcatggtggtgcacacctgtagtcccagctacttggggaggctgaggcaggagaatcacttgaacttgggaggcagaggttccagtgatccgagattgcacccctgcactccagcctgggcaacagagtaagactccatctcaaaaaaaaaaaaaaaaacctttaagtagaaggcagagcctttctcaacatgctacaccattaaaatgtcacatgttccttttttgagaggtagggagaacactttagggagaaattgtctcttcttcagagatgtggctggcaaaaaagcaaagggaagtcgggacactttccaaaaaagcaagctacgtagggcgcagactgcgggcaagacaaaagacctctccagccatcctgaaacattaaacccaatttccttatccccagcaggtatctggcacaactcgcatcattacaattttctagtgtactgagctggggaaatgtttccaaaggaaactgagtagttaccaaaggaagagttgaagacactttgccaattctcttttcttaaggacttagtaactcagactttttaaggtaggaaagattttgccttttgaaaataactagagtttttgctaccttgacaattttaagcaacactgaaagaaccgtggaggttgtataaaccatttgaatttttccgtcatagacctaataatcaggactctggaatggatttcatcttttcttatcaaaagggctgctctcatgctcaatcagctattctgtttcttttcaaaaccgattttgtgttagccatggggagtcaggcagtggattgtctaaatacttttatacagaaacaaaaattcatgcttgatgttcaggtcagttttacagagttgtaatttagaggcattcaagggagtttaatggagaaggaaaccagtcaatattttattcaatccaaacatgaaccaacattattaagtcgaggaatctttctgctgagaaaataatgtcacaaaggttcagtcaatctctgggagaggaaggagggttcataaaagactgcacagtttacatgtgttgtgggaatttaaattttagtaattcttgatgcagaattggacctgtggaattagtcccattttacctccataggaagtgttcaagccagctttctaagcagatttcaaattctgcgtttaattacatttcctaaaacccttagtttgcacacacagcccatgctactctggctccgatgtccttttcagttgctggttggcccttcttcatcaggagccctgttctcgactaaaacccagctccacgctgctcccatcctgctaggcatggtcatgatcatcccaatgcctgcaatgccccctctctgtccagggaatgctttctgatctttaaattcctgaatcaaatatcaccttcccccttttcgctcctcttatgctgcctaacaagcttaattattcttatttctctgttttacctttgctatcaccttattgccatttatcatggtggctcattttaccttttttttttcttttccttgattacaagctctttgaggatcttttttttttttctttcctgcctggtcagtgttcaatacttactgagtgactgaataaatatatatattagataatgcaattactatggattttaaaatctaagatcaaattattacatttgttgtataatcagatattttctttgaaaagttattctttctccaaccagtaactcctctgagcaagtggtgcaagcactgcctaacttcttgagcgtagagtatgaggagaaggagcagttgggtacccacaattgtcaggataccaataatctgaattgtgggtaaaaaaattattctttagagctatgcttttggattcatggcaagttgatgttcacagggttaactgaaaataaatgtctactgctgttgtgcactgtaaattgggtgcaagttatatggcctccactgttcaagatatatgatgagtcgatttctaatgattgcaatacctcatgagataccttacccactcagttttagagataggaaatttgaggttcagaggtgtcaaaatgatgtctccaataccaaatagctaagtaaatgttgaaactaaaaggggagccccctgccaaagacatcctatgagtagcaatagaatagccagaagggcagagtattggggtggtggtggtggtatcagttctcatgattttaacccaaaatgacagtctaagaaggaaagttagcatagaatattctggtagatatcatgaaactcccactccaacttatcagaagaaaagcagcccttttcagaagcagccgactctagcccttggtatgtcttgtcagtggactggctcagatctcataatagtgccatcccttgggggactttttggaagctgcaaacctcccgacagaagcgctgtctaatgagagcctcattcctccaagtgctaagggcaagagtctgggcagaaggatgtgtgtagtgctgttgtgagagaactggttggtactgacacctgaaaaatctccactagcttttctgcaaattataacattaatatgcttgagttcagccattgggaaattaaacctaatgtactatagataaaagattgtaggccttattcaaaataagattcagaattaaagaagactatgcatggtacctccagaaacactatgtataatattaagtattccagaataatcataagaatgcaactaacatttttggatatttacatgtgacaggcactatgctagtcattctatatatattatctcttttttttttttttttttttttgagatggagttgactcaccacaacctctgcctcctgagttcaagcgattctcctgcctcagccttctgagtagctggggttacaggcatgcaccaccacatacagctaattttgtatttttagtagagacagggtttctccatgttggtcaggctggttttgaactctcgacctcccaaagtgctgggattacaggcgtgagccacagcgcctggccttatgttatctcacttaatcctcacaaagaacttatgatatacacaaacactatcattatctcgttttacggatgagataacaaagttacactgttaataactaacagaactagcacacaaactatattatgctgatctactcattttccattcaaattaattgaggactgaagacccaaagatgaagggacacaacatctgctcccacagtatgatagggaaatgaataaaacaaaccaattgttcaatggaactatggcactatggcataagagagaggcagaaatggtctggtaggctaggggtgggcaggggggatttcggagctatctgagacttggaataataaaaggagtttctaaggtagaagaatcaaattataaaactggcaaaagaacatagcatatgctcagagaatgatgggttgttatagtttgaatggatgaggtccctccaaaattcatatgttggacctgaataatcaatgtgataatattaagagatgtggccttttgagaagtgattatgtcatgagtgcttcgcctcattaatgggattagtgctgttacatgagaggttgaaggaagcactctaggaccttcagctcttccaccccttctaccatgtgaggacacagcattcatcccttctggaggatgcacttccaaagtgccgccttggaagcagagagcaagcccttaccagacactgaatgtcagagccttgatcttggacttgccagcctccagaactgtgataaataaatttctattattgataagttacctagtctcaggcattttgttatagcaccaggaactgctggtaccaagcagtggggtgttgctgttaacaaatatataaaattgtggaacaagataatgcagagaggctggtagattttggaaccgaatgctagaaaaagtctctattcctgtgaataaagcattaaggcagttctggtgataactcaaaagagaacagctgtaggggaagccttaatcttacagactacttaagtggttgtgatcagaatgctgatacaaatatggatggtaaaggcaattctgatgaggccttagatggaaatgaggaacgagggattgtaaactggagaaaaagccatcctgtttataaagtggcaaataacttggctgaattgtctgtgtcttagtgcttagtcagaagctgtgagcaatgaactagagtatttggtggaagaaactgctaagcaaaatattgagggtatggaacagcttctcttgactgcgtatagaaaactgtgtgtgagagaaacaaattaaagatggaatttatactcaaaaggcaaaaagaactcaaaagatttggaaaattcccagcctggccagattgtaaagaataaaaaggtgtgttcaggagggaacaccagggtgtgatcaagtgatatttgataagattagtgtggatagaaggaagccagatgcaattcagcaagacaatggaagaatgaccctgaaggcatttcagagagctttgagggtgctcctcccatcacaggcccagaatgccagggccttgagagcagaatgggttcaaaggatgggggccaaggtccctgtgggactttgaggcttactacccagggccaactcaatttctgctccacccattccagtgcagtgctctttggctgctccagcatggctcaaacaggtacaggtttaatgcaggacactgctccagaaagcacaggcagtaaatcttggcagcacccacctggtgctaactgctggtgcacagagtgcccaagctgtggaggcatagctacctccacctaggtttcaaaggatgccttggagagcctcatagcccaagcagagaactgccacagtggtggggccacctcacagagcctctactagggtaatgcctgatagagctatggagtattccacccatgagagctgctgtgagggctgtgcccaactaagccatggacgggtcttccctgggttttgggtcccaacccccactcagtatgtcaagaaggcaggacatggagtcaaagaagattattatcacgcctcagaggtgaatgtcgtttgccttgtcgggtttaaatttacttgtgaattattacccctttcttctttcctatttctcccttttgtgatggaaatacctgccctgtgcttgttccacccttgtattttgtaagcatttaacttgctggatgtcacagattcacagctggacaacaatttgcttcagaatgaattgtaccttgagtctcatccatatccgagttagatcatatttacaggagactctggacattatttttattttttccttaaatagtgtttgaggtacaggtggttttttgttacatggataagctcttttgtggtgatttctgagattttggtgcacctgttacctgagcagtgtacactgtactcaatatgtagcctttgatctctcaccccctcccaccctttccccacaagcccccaaagtccattgtatcactcttgtgcctttgcctcctcatagcttagctcccatttataagtgagaacatacaatatttggtttgccatttctgagttactttacctagaaaaatggcctccaactccattcaaattgctgcaaaagacatttttcattccattttagggctgagtagtatttcatggtgtgtgtgtatgtgtgtgtgtgtgtgtatctatgtatctctctctctctctcacacacacacattttctttatccacttgtttgatgggcacttacggttccacatctttgcaactgcaaattgtgctgctataaacatgcgtgtgcatgtgtctttttcatagagaattcatgactaagacccccaaatcaaatgcaacaaaaataaaaataaataaatgggatctcattaaactaaaaagcttctacacagcaaaagaaattatcagcaaagtaaacagaaaacccacagagtgggagaaaatatttggaaactatacatccaataaaggactaatatccagaatctacaagaaactcaaacaaatcagcaagaaaaaaacaaataatcccatcaaaaagcaggccaaggacatgaatagacaattctcaaaagaaaatatacaaacaaatggccaacacacatatggaaacatattcaacatcactaattatcagggaaatgcagactaaaaccacaatgagataccaccttactcttgcaagaatggccataattaagaagtcaaaaaacaatagatgttggttggtgaggattggtgaaaagggaatacttttacacagctggtgggaatgtaaactagcataaccactgtggaaaacaatacgaagattccttagagaacttaaggtagaactaccattcaatccagcaatcccaccactgggtatctacccagaggaaaggagtcattttgtgataaaagagactctgaactttagaattttgagttgtcgctggaacaagttacaatctttgaggctactgggatacaaagaaacaatgcatttcgcatgtgagaaaaacatgaattttcacggggccaggggtggaatattattgtttgaatatatatgttcctccaaaatttatatgtcagaacctaatacccagtgtgttggtattaagaggtgggaccttttgagaagtgattaagtcatgagtggtccaccctcaggaatagggttactactctcataaaagaggttgaaaggagtgccctaggccctttttcccttctatgtcttctaccatgggatgacacataatttttcccctccggaggatgcagcaacaaggtaccttcttaaaaatagatagagagcagcgttcaccagacacttgatctgccagtgctttgatcttcaacttcccagcctctagaactgtatagtctgttcctgctgctataacaaaatactttagactgagtaatttataaacaatagaaataaattatggtttacccagtctaaagtattttgttatagcatcaggaacagactgaaaaatggatactatgtcctgtatgactggcgcatagaatgtgaaacagagagtgacagggcatcagagtggaatatgggaaaaggccaaatcctgaaggtccttgtatgtaatgcaaatgaaataaaattttatttaaataaaaggatagggagccattgaagaatgtaagtagagttggtatcaatagcgttgctatttatgatgatcatgttatggagtgaatgagtgtgtgtgtcccctaacagtcataggttgaaattctaacccccaatgtgctggggttatgaagtgggacctttgggaggtcattaggtcatgagggtgtagccctcatgaatgggattagtgcagttataaaaagacacaagaaagcttgctttctctctctgctcttcaccacatgaggctacaaggagaagcaaacaatctgaaccaggaagcaggttcttaccagacataggatctgctggaaacttgatcttggatttctcagcctccagaactatgatcaataaatttgttgtttaagccacccactccatagtattcttttatagcagtccaaacttacaaaaatatatcactttgatggagtgtagtgaatggactgataatggtgagactagaaataaggaagctaatggagatattgcaatagtcaaagccttaaaattgagtgggaggagtcggaatggaaagcaaataataaattccagagtatgggtagcatagaatagtggctaagaatatggcttctgggctggctacttaagcttgaaccccagcactgctacctcctagctatgtgttctttgggaacaccattagcttctgtgtttgagtttcctcatctataaaattcataataatggtatctacctcatagtgttgttgtgtatattaacatgacatttgaacatgttgctgaatattaccgtacagttatgcactttatgtgatgtgcctaagtgtctagcacaaagacagcattatgccagaggcatttgtgtctgtgtgtgtgtatgtgtgtatacaatctatatatactttttgctcatcacaatgggcaaaattatttttgttataaaattgtattctaaagtaaatttaatttacttaaaattatattcaggacaagtaggcacaaaaattagcctggtttagaatgacaaatatgtataaaaattaaaaatgtgattctttaggccaggcgtggtagctcatgcctgtaatcccagcactttgggaggctgaggcgggcagattatgaggtcgagaaatcaagaccatcctggccaacatggtgaaaccccatctctactaaaaatacaaaaattagccgggcgtggtggcatgtgcctgtagtctcagctatttaggaggctgaggcaggaaaatcgcttgaaccctggaggcagaggttgcagtgagccgagattgcacttctgcactccagactagcaacagagcgagactccatctcaaaaaaaatgtgattcttcgacatttatgtttttgaggtccttttaaagtcctatagttgcatggtataatgactttggagatagaatgtttcagaataggtaacattaaaggattgtcccatgtaactggattctcataattgcttttttctttttattactacttaatacatatcctagataacccagataacttggttttgaagaactactaaaacacaattaagtattatcttttaccctaaatgtggttagactctctgtttaaaattattgatttttggatcccatatgctctggaaattttagtgtgttttaaagcaaaatataagagaatgtgaaccgagggatattttactctttacagcatgttgaacccaaactctcactagtatctcatcgtatttcccaaaggtttgccaggataaacttcagaagcagacagggtgccttggctcaaggatttgagaaatttggtcttactgagagaaaatagagtgagtaaataattattttcaataaaggattgacctggtcaattttacgttttttttttttttttttttttttgtaagatctgatgttgggatgaggaatagattgatcagaagatagttgtatggagacaattagaacattcctaactacttcataagagagatgatgtaggcatgagttatggcatgtaggactggacttaagaggaagagaaagaactgagaaagtggtagaaaaaaatctcatagaacttgatggctgattgaatttgaatgactagggaaaagaaggagtcaagaatgatcccacatttctaggctgtgtaaccaggtagaggatcatgagccccaactgacagagaatgtggaagaaaatgtagctttggggtatggagaacagaacgtttagttttggacatactgaatttcaaaggtctatgccagagctaggcaggcatgaccagcagataatgggacacacagctccagtgagaggtgtgggctggagatactaatttgagatttattaccagaggtgggagatgagtcatgaacatgggtgtgctcttcttaggagaatgcaaattgcagagaataattggtcaagaacagaaccctaaggaacagaagtgcgtaaagaatttgtgtagaaatgaaacccttgaagatgaaagaattctggattagacatgtaggaagaacaccacggaaaccaagggagttgacaatagttttggggtagaagggatctattttatgttgtgaaatgtccaattagataaatactaaaaagtttccattacgtttttaaaatagcagactttttttttttttgaaaaccctcttattcagaacaggttcagtggaatgttaggggtagaagccatattgaagacagctgagaaactaatcctaggtaaagatgtggaaattgcaagacctcactttcaaaaagttttgaggagaagaggagaatggcaatactactgtagagcatactttgggaaactctgggaccacctgggtcatactttgggaccaggagaggcatgtgcctatttattggctgagaggaaggagcttatagaaagtgagcagtttaagataccatagagactccggccattgtggctcacgtctgtagtcccagcactttgggaggcaaaggtgcaaggattgcttgagcctaggagtttgagactagcctgggcagcatagtgagacccccatctctaaaattttttttttttttccaaaatttagccagacatggtggcacacacctgtagtcctagctactcgggaggttgaggtgggaggatgcttgtgtccaggaggtcaagtctgcagtgcgacatgatcatgccactgtactgcactccagcctggacaacagagtgagaccttgtctcaaaacaaacaaacaaacaaacaaacaaacaaaaatacaaaagagagagtgatggctaaaggaaaatgtatgggaatgaagaacattctagtactcaggtgccttaactttgacccagaagaaatttttttgtaatgagagcctggaagaaaagagcaaaagaagtaatggatactatcattgatagaactttcagcagagacgcagaaatttgtggcttataacattagatggcatcaatattccccctgagataggaaacaaggtcttctaaaagtgagaaggacagattatttaatacaggggctaaagagaagccccttcctcttgaataaagcctgtgatagatgatcttcaaagaggaccaccatcaacttcttcttcccctggaagcacacactgccacatcccacatcaagaggtgggatttgtttccccttctcttgaagctgggaagacgtgttattgcctttgatcaacagaatacagcagaaataatgttatgccagttccaggcctagctttctaagcatagtggagttccccttcttctctcttagaagccagctaccatgaataagaaattcaactactctgagatcaccaggctgtgagaaaagctaagctagctgaattaatttgctaggactgccatgacaaaataccacggactgggtggctgaaacaccaggaatttattttctcacagctctaagagcaaggcatggacgggattgcttttcactgaggtctctccccttgacttgcagatgactagcctcttgttgcctcttcacatgggaatgcacgtctctctgggaatgcacatccctggtgtctctttctcttcttatgaagacgcaagtcataccagattagatctcatcctaaaggccttatttaacttaaatgtctctttgaaaccatttttccaaacatggttacagtctgaggtactggatgttgggacttcaacatatgaattttgaggatgcagaattcagcatccaacactaaccatgtacagagatcatgagagagagggacaggacagatgggcaatgtggagattcattggtcagtattctgagcttatattttctcacataatcatccttcacataagtctctttaagcacatagagcaaagctgtatcaatttcatgctgcagttacacctttctatttagaattcacaaaacaaaattacccatccccctcaaaaaaaaaaaaaaacaaagaaaataacacatatacatcttctgatggaactaaatctgatatgtaaaatgactcaagaaaaatccccagctagtgagactgtgctactctctattagggtaataaaataacctgctaatatcactggcttctgatacaattgtgatgtgtaatatataggctgggagaccactgtggatatctatttttctctcatttttccttatataatttgggaagtggaaggaattggaaactacaatttcctcatgccttcataatagattctgtacatcctttggaaagtccacaaatctaaaactttaaaaagctacagggatcaggcgcggtggctcaagcctgtaatcccagcactttgggaggccgaggcgggtggatcccaaggtcaggagatcgagactatcctggccaacatggtgaaaccctgtctctactaaaaatacaaagattagctgggtgtggcagtgtgtgcctgtaatcccagctgctcaggagtctgaggcaggagaatcacgtgaaccagggagttggaggttgcagtgacccgagatcgtgccactgcactccagcctggcgacagagcaagactccgtctaaaacaaagaaacaaacaaaagctacgggaagtaaaatgttgtcagtttaattctatgagaaggtccatattgtgataagggaataatattaagtcatgtacagaaggctgatactcagatacaatagtgaccatctacattgcagggtggatttgaagctgtccatttcatcccatcctctgcaatggaatgggaactccaacaccttctccaaagctgagtcgctcactcattctctgttattctcttggttttctaagcagactgtgttccagtttccatttcattctgtattttcttatgcacattgtttgttgaatttttatatccacacagaaatgcacatccctacctccatacctacacacataaaagatttttgatgtatggatgctggatgcaaggactaaagaatcaaaagcccttggaataagagagtactgagagataggacaaacacattttttcaatgttcagacttgctggaaaggagaaaataccctaaagaaagtgtcagaaacccccctttaggcctcttttgttactctctctagcttttcaattggggacgtcagttttgctggtgatggcataggcagggcaaggcaaaattaatataaaattagagaagatacgctataaaccggcagaggtccatctttaaaccattgtgaacaggcaggggttcatctttaaaccattgtgaagtgtgtcttctctaagtttaagacgaaggtccagtcttctccagtggggccagaagcacaagtccttttattttttattttatttttttttttgagacggagtctcactctgtcgcccaggctggagtgcagtggtatgatctcagctcactgaaatctctgccacccgggttcatgccattctcttgcctcagtctcctgagtagctgggactataggcgcctgccaccatgcctggctaattttttgtatttttagtagagacagggtttcaccatgttagccaggatggtctcaatcttctgaccttgtgatctgcccgcctcagcctcccaaagtgttgggattacaggcgtgagccaccgcgcctggcccagaagcacacattgtaagagattctgccttctttgctttcaggccacaaaaataagaggtggggcctggtccttgtaggatttttttctataatatacttttagtttagctagtattatatttctgtgtacaatccatttctgttattaccatggttactactattgtttattatccttgataatcactagcttgaaccactgcgataagtttgaagctgatttaatagcctctactctcattcctctcactctgctctgtcagagtgatatttcttaaacatcaatgtgaccatatctgtggcttgtcctttcggtgatctcatccagtctcacggagataagtatgatatagatgttggtgtcatcagtatttatttcccagcctggacctctcctctgaactctagatttatatatatgcaactacttactccatagctctcttcggatgtctaagagacatcctaactctccaagcaagatgaggctcctgatcttcctctctaaatgtcatcctccctccctcagttctcctttcccatttcagaatgtcaatccattcttctgaatgctttagtcaaaaaggtcagagtcatctctgaataggaactgagatacataggctaaatgacatcatggcatcctcattacatgagtcagtaagtagcagcatcaggatatttactcggacagtgtaactccagagtctttgttctttacccctatgtttgactgcttctctaccttataaatccctttacaggtaatccaaaaacttcatatagaatctaaatgacaaatgccaactgctaacctcaaggcaagcttgctacatcaaagaactatgaattctggtctacctagctgtctgggaaaagagctgaaaattcccttggttgagggccaagatcttttgattcatttttctctctctttcttataccttctgcatgttcttatgggaatcctagattctgcatgttcttatgggaatcctaggctgtgattttgagatgggaattcagaagtttctgttataattctgtctcagctactaattagctatatggccttgggaagtttctaaactttttggtattttataattactctgccaaaaaatgacatgcatacactagatggcccagagtctatagcaataatacagaaaaaatgtatagagaaatagataaatcaaattacagggcctgtttgcttcttgagggaaagaatcacaagtttgtttactatccatctcccaagtgcttattgaagttacatcttcggcagaaactcagtaggtatgtgtgaattgctggttgaagattcatgatttgctatatggtacggacaagatgccttagaattccagaggcagtttggaatagtagaaacaaatctgaattgagaggcagacaacaggatctaatagcagagaaggcagagatgtgtaagttagttgacttcaggacaaacatctatcatatagtcaagacttttagtatttgcctctgtaaaatataaagagagtgggattggttgatctcaaagatatcttaagggagctgtgactgtataatttactttttccataaaacctaaaaagtgtaagcatgaaacatttttgtgtgtgtatctattccattggaagggctcagcaattgagcatcaggatctagcacatataatcatctgtttacatttcatttattttagaccccacaccaatactgtgaagtggataataatatctccatttatgcataaggaaattgaggtccagggaggcttttcaaggtaaaactcagtgtcagagctgggattgcaatccaggattaagtggctctcagtttcaattctctttgcattgaaccacacatcctccccaagtctctggcactagtgatgcacatcaggaggcaatgtaggggctcttcaggatataaagagggctcatgggtacaaacatacagtgaaaaggacatggccacacttcttgaaaaccaggttcatccaactctaacagaaagtgctatgattagccaaaaaatatattctagtcacacacacacaaaactaattaattagaaaaatctggtgattaactgcatgccttcattgttttcaataaatgtaacctgtccaataaatcagtaacatttattaatgataatacaaagtatattcagtaataggcttgccttccatgaggagactaatatggggttttatatggagtcccaaaagaaaccaaataaacattgttagcatttgcttcattgcacagattacatggtgccttgattctgctgctgacaagcagtaaattgctctgttgtgtgtggtgcttaaaacaggtttaatctgctattattaatagttccatgaagaatatgattgcctatccccatcccactttcaaccactgtggccaacatacgggaactcaggcaactaaaataattacagaccacaagctgtaacaataaaccacaaaaggactaatcatatcctttcttggaatttacttatttcaaatagtttgttactttttttttcatgaagagctccatattggaccacaattgtgatgagaagatctaacttggatttcagctgcagaaattatgctatttactttcttattacaggcactaaattgctgtttggattattattatttttttcctttctctagatagttcaacaaatagattttacggtctctttatgggacaaagcagagtatgatttcgaaaagtataaagactaaataactagataattgcctagagttgaagtggtgtattcaggaacttcactgggaggaactaaaaataatttaaaaataggagaaagtgtcattggcccatttatgcaaagccaatgcaaagaaaagctgaacacttgacttctgagaaattaaagacaaactgtggtgccaagttacagcaattcccttggcctaatttttggtaaatttaattttatcctttctcaatgttgtggaatctataatgtatattttattggtcatattatatgcatgtctcatgcaggtttccttcagaacttcttgaagatcaatagggaatatattaaaaatgaaaatagaaattaggttgaatattggcctacctacaatggttgaaaaatcactttagaaaaaagtggttttgcttatttccttgttgacctatttgaatgctttttatttaaaaaaaaaaaaaaaggtcctcagcatgaaggatttggtaggtgatgttttatctcactgtaaacatttctttttgctaatcaaggatctttgaatgacagaagggattttaaggaagacaacaagttagtcttctggagtaacattatctgctctagtgaactggtcctttggagttcggtggttttaaaggcatgctttcttttattatttggagattatattgtttaaagttttctgcatggtgaatagaggttgctaggggaacataaaactctacacagagacagaactatgactaggtccaggctctgtcaccaaatagcttgtgatgctgagtcagtctcacaaatgtgcagcctgttgtttcctcttccacaaaatgataatatttctcttcatgtggctttggcagtgatatgacctattacatgtgaaggcattttatgataacgtgcggtgcacattagacatcaaactttgttaacatattaataatatacctcatttggtgacattgttctttttcctttataatttttcaatgataattattaaaatctttgtcatcaacttagtgaaaccccgtctctactaaaaatacaaaaatcagctgggtgtggtggcacatgcctgtagtcccagctactcaggaggctgaggcaggagaatcacttaaacccgggaggcggagattgcagtgcgccgacattgtgccactgcactccagcctgggcaacagagtgagaccccatctcaataataataataataataatactttaaaaaaatctttacgggtcatatgtgccccctcccagttcaccaactttgccttctcactggatggttctcataacttaactctatttccacctacttttctaacacggtatttcataccatacaaattggtcctttacgcaaaataatttatatgttaatgacttggtcagatgggctcaatattaactttttcctcgaaggtgctagtttgttatcccacacacagtgcagttaatacactcataaatgtccttcaaaaatgtttctaagggccctgcagactgaattttagactccgtgctcatttttacttcagtaatttcattagtagtgtttattttataaatagtttgtaaagtgtttgaaggcagaaacatttttaaaatgtttatatatttttgttccaaagtattttgcagagaaacaaatccacagaagcacccctaaactgggagtgtggtgaagtggggaagagcccagcccagggctgcagatctcgggatccaagaatacatagcaggtagctcaagagggaatttagagtctaggcctgcatagaattcacctgaaaaggtggaacagagaccaggactgaaaccaggaccaaaacaaggaccaaacaaaccagatattccagagaagagtaagtggtttctattggtaagagttgggattagcagaaatttcctgaaacccagatgtagtcacagaagccctagagatcccatggccctgcctaagtgaaattagggagagggctcagtggggtgtcttgaatacatttacttgttcaggtgtcgaataatgcctattgagaagcaactatgtgccaggaaaagtacagggtactgggtatatgtgggtaagccagacagcagcaactctgccctcatttacctcccatctcagaaaacaataaacaaattcattaattattagagataatgataaatgctaagtaaggaacaaactggacacagcaggggtttcacctacatggagctgtgattaggggagatgatgtttaagatgacattggaagcatgagaaggaaccaaaaggtcctcagaccaggagaggccaaaagctcttctccatgagtgatttaaagtaaatgtacataaagagtagccagtggaggagatggttgttagcaccgtgatggaaaggtattgggaaatgctggaaaagcatggcataagggcaagaagggaaggtcacccaaaggcaaggttcttgtgggcttcccaaacctcctctgcttctctgcaggtgccagaatttggttatttctctgggaagaacttgtgtcatgaaattgaaagaagcccaagagagttgcgccatagagaatgaggagtgtttgtcagatatatagttgtcatttactgaatattgtggttctcatcttagtttactcccaagaaaatacctggaggctttcaggtgcttctctcttacgaggcctggtactaatgttttcattcaattctttgagcttccctagattcttttaggaacttcttttttttctcctgttagatcaagattctgttgcttaccatcaaagagcccaagctaatacagtcacctctctgtccttatcttgcttgtctgcttagcattcaatgcctgttttttgaaggactattgtctttgggtttatgtgataccacatcctcctggttttctttccatctctctggttgcttcttttcagtgtcctttgctatctcttccagctttactgatcctctaaatgctagagtccctcctgaccaggactaaatccttttgtctcttttaagtcattcttagtggtcaaaaaggtatgcacttaggtgctagggtaccttggttcaattcccagccttgccacttcctagctgtgacctcggagaggtcacttaacaattccttgcccatttcttttattattattattattttaaaaaaacctatttcgtagggctgctaagagaataaagagggttaatcatacctaaagtattttgggcagagctggttcattatatgcattcaatgcatgttatttttcttacaattgttagtaatcatcaattcccatggccttaaatgttacatatatgctggtgacccttaaatatgtattttcagccccaaacacccctcttagctctataaaattatgtatccaaccactagaatttatcaaactttagaagactaaattcaaattttgattactaattcttaacaccccccaatctcactcaacaatttccccccagttttctgcatcttagtaaatggtaagaatacctgcctagttgtttaagtcagaaaacttggaatcatctatattgttgctctttccctcctagccacattcaacctatttgtcaaattctgtcatttttatttataaaatatagattaaatactttcacttctttgtatctcaacaattaaaatttctaatccaatgtaccatcataacttggctagtttactgcaatatcttctttacccattctttatttttcctccatgaccaaatccattatttgccaaatagagttttgttttacaaacataaatttgtgtcattctcctacttaatcctttaatgattttgccctgtgcaatgagtcaaatccagtctgcaagactctgcttgacttgctgtatgtctacctggctggtctcatcttatatcaccttctccctcaatcatggtgatttggtcacatcaacctccatcagtttcttaaatccaataaaccctttcctgccttagggcttttgcgcttgctgtgtcttcaaccaggaataactttttccttgcttctttcattactggttttctcctgaggtctgccattaaaaaaccctcaacttcagaaaggcctgctacatcactcagatttctccagagaagagagatgattggatctatgtctatctatcatctatccatctgtggatttattttaaagaattggctaatgtgattatggggaatggcaagtccaaaatctgtagggcaggtgagcaggctggaaactcaggcaggatttcaacattatagtcaaggcagaatttctgcttctctgggaaacctcagtttttgctcttaaggccttcaactgattgagtgagccccactcacattatcaagggtaatctgatctacttaaagtcaactgattatagatgttaatcacatctacaaaatatcttcacagtaaaatatagattagtatttgaccaaacaactgggcaccctagtatagcttagttgacatataaaacttatcatcatactttccttaggtctcctgcatccacaggagtctctttcatagagttctctctttttttttttccattggatgtaccataatttacccttaagtaattctttgcttacttattaatttccccttcctccaccacactctaatgtctatcaggtgagaacgattcttttttgcatcaatatatatccaatactagcaaagtccttgggatatattaagcattcagtaagtagttggtgctcgatgcttaatatgtgtttgtgaaaacaattaacaaccacagggaacttgagatgaaaagttttgacccaatcttctaaaatttttatgggagttagaatatcagatgttaagcataatttactaaaatgtgaatagacaagaaaataactgattatttctcattttcttttgacacattctcctcccttgtattttcctgaaattaaattagtcaacacagatttaagaggacttagagtctcacacactcagcccaaatatagcattgaaaagacttccaaagctttggcaacatattttattttaataaagattcaaatgcctgcaggatcactggaataattgccagttacacttctattaatgaacacatttaaatggggattgtgaaaagcagaaaatgatctgattttatggagtacgtttactgccagcaatgtacagtgatgaatggtgccctagaatttaattttagttttagccacaaaacagccaaaattgcacagcagcctctttaacgaatatgtactgaacttgaaaaattatttattgagttctcagtgatatatatatatataaattatttattgagttgtcagtgctatatatatatatatatatatatatttttttttccttggagatggagtctcgctctgtcacccaggctggagtacagcagtgcaatcttgctcactgcaacctctgcctcccaggttcaagcaattctcatgcctcagcctcccgagtagctgggactacaggcatacatcactatgcccagcaaatttttttttttttgtatttttagtagagatggggttttgccatggtggccaggttggtcttgaacatgtgacctcaggtgatccacccatctcagcttctcaaagtgctggtaatacaggcatgagacaccacgcccggcctcagtgatatatttttgtgaaccaattagttacttcaaaaaataaagaagagtaatgctgttaaagttgatccacatagcagtcttattaccacccttgcatgggctctgtgctgtgaagactaggttctatgtgcaacaagttctattaacaagcctctttggatgaagctgcttttgaacttgatatgcattcagttctgatgtacagtgctaaaggaagtagaaaatctcaaagggttcataagacagagtcttagtactatttctaaatgctggttcttcaagtggtatttgagtttgaagtacatcagttcacactgctcccagactaaaacaaaaaaatgtcttagaaggattagctgaatctaaggaaactttttaggaatattaaccagaaaaattcaggagaagcaagttttgttgactttatcagaatgctgtttgttcccctaaatccaacttctccttttgcatttatatactgatatttagccagaaactacatttcccatcttcccctgtagctagatgatccctgtgactaagtttgagcccttaatgtgaataaaagtgatgtagagactcttcatgttatctttaaatccagactcacttgcccctggactatgactacctcactttccctcaggatctgaacatgacactgacccagtttataggatatagatggtagcaagggatagcaggacaatgtgttggaaggaacctgggtcgctgaatgacatcctgctagagcagagctgccacatcagcctggaccaaaccaactatgacttgaaagaaaatgggagctttcttataggattgttgcagatgaatcaatacagaaaatcttgaagtctttagaaagacttgtaatgaatttttatattatttagaggttacttttacataagttgtttttaaaaactacctacattttaatgttatgtctttaagacatcaaaaattatgctatctcttttgatttttgcaaaatcccagtgagggaatcattatgagaaagattatgttagcttctggaggaactcaagggacagaataaaagtaaccacaataaaggcactattttcagatttgtcctctgacaactctttgtagggctaagaacaaatctgtgttttctaactttttttagggaggtgactctcaaatctgtatgtgtgaatatatgtataatattaccattgcgataaaacttataaagtgatgtctaacaagtaagtcattagacatccagtgcttagcatgtacccaaattcaactatattccaatttgaataaagcatatatacatctatagagatatagatctatagatatagatatacatagttttcaaaaagcaaatatctacctatagacatctatctctatatatctatacacatagatataagaatatattagattcccctattttagattattcttcaaaaagcaagtagatatctatattgtataccatgtatatatctatattatatatatatatatagataggttatttttcaaaagcaaatttatatatatatatgtacataatgtgaatcaaagtttgagagggggaaaaagaaactttaagaaagaacttctagattatacaacacaattcagagtactggcatgataataatggtgctaatagtgataatgataatagcaataacaataatagcagctacattttgagtgttgtcatgagacagggtctgtgctttttgctttacattcattgtctttgcaaagcatctatgagatgttattcttcaattttgcaggtgacatatgaaacccagggagtatcttgcccaagggtaaccagaaccagaatctaattacattataaattttacctcaacatatatccatttttgcacagaaaagagttagcataacaggtgtgagatcactgtccttagaaaggcctgcttgcaaggctagccacttggatgttgggaaagtgtctaccattctttgaagcaaatggctcactgtgcttaaactgtgcaaacaatatggtttatgttgaacatctgctttgcttcttggagtctggaatttgggtacatactaagtactgaacgtctaatggcttccttgctagacaacattttataaatgctatcacaatgactcattgctgggagaattaagcacttcctgtgagacttcactcagaaagaactcttggaagcttgcctcaggtttcctccaaacattaccccatgtgccttttccctttgcagattttgctttgcattcttttgttgtaataaatcataaatgtgtgattgtatattgggtcttgtacatcccctagcaaatcttcaaaactagagacagtcttgggaacccctaacatatctatcttccatgtcattctctcatttggagaaaataaaattttattttctacctgagtacataggaagacgtatttctcagcctctcttgaaatcaagttggaccatatgactgagctctgatgggtggaatgtctgttagtccaaaataggcccatcaaatgccccacaccatccttctgctctcaactgaggaccagatgcagatgacccagtggaggaagctggcaccataggcaatagtggaaccacgagatggaaggagtgtcctcaataaatgagttgaacagaagtcccatcctgtccccaacggagtcacataggattaggaaatgaaagagaaacaaacatttttttgtcttaaaccactgagttactggagctgtgtgttacagcattgatccttctctgtctaatacatatggtgacgtgctggataccaacacccccatctccttccgctcaactttgaaatatgttgcaagagtgaaagggatttttaagccatagagatcccattactcatttgatagaataatatttgatgggcaaacacaggacacgaataatctaccagatggcgactcttgcaagggaatcaaaggaagttcttcattaccatttgagattgctcttaacatttttgagtagtacttgataaaacaaatagaaggtgttaaactactgggtgtagttcttttactaaaggagccatgctctttcactccccctattattagattatttttcaaaaaagcaaattaacagcacttcaattttactcagtagatgtggaaagaactaaaaagaagaaagtgagagaagataaaaattttattgggctggcctccaatctttttgtttggggtcattcatttgttcacatatatttattgattacctgtcatatactagacacagcctgaagggctgagaattttgtagtaaagaaggtgcagcacctgctgtcaggaagcttaaagaataggggaggagtccacaagcaaagaggaaacccaaaataagcactatgatgggagcacatagcagagtctccaaacctactttaggagatatcagagaaagcttttccacagacaagtctttcaaccccaaaactctcaagatagctgtgagtcctcctcagtttccctccccttttaatccaaaacatcacgacgtccactcagctcaacctccaccacatatccaagcccatcatttctctccttctctacttgctactaccctggtctatgccacatctcctttccgtcttaatctcttggaccagatttctagagggtccccaattttactctgatgtcttacactccattttgcttagagtagccctccagggccatcttaaaaaaaaaaaatcaatgctttgtttgtatctgaacttttaaaaactggtagttccccactatccttagaataaaatacaaatgacgttccaggttccagccactcttgctcactcttgcctcatgattttgggttgttctttatgcctagaaagtccttttttctaccttcccatggccgtgcccttcttgacattgcagatacaatgcaatgccacttccctttctctagccgccccatcgaaagaagctccctgctctagttctttgtaacaaatgtcatcctccttctactgccactagatattttcttatttaactatgtgtttgctttttgcccctcttttcactatcttcccccaatggaatacaaactctaaagaaaaattacctgtctttttttgtcagtgtatcctaaataccttttacagtgatgagcctgaactcagcactcagagaataagccatgaaaaaatatattgaaaggaagtctaagtatggatgtggagaaggtgtagctgttgtcctgatgaagaagggaattgtgggaagcagcatttctcgcaggagaaaaagtccaggtcaaggcccttcagaggggtgcacttcagctgcaggcagttccttctggctggagcagagtaaatagggatgagtgaggggtgagacgcgaaaagtcagcagaagatggttggtcaaggcctggctgatcgtgaactagttgggtcactgcagtatagacagcatctaacccaatatctgacttatagtagatgttcaagaaatatttgttggatgagcatgtaaggcaattgagtctctcttctaatggcaaaaaaaaaaaaaaaaaaaaaaaaaaaaagccagcaattggttttaagtaggaactgactggtttctatttgttctttagaaagaccttttcagctgcacagtggagaatggttcagaggaagacaggactgtaggcaaggagtctgggtcattgcagacatgcagatgagaggtgacagtgacagcagcgtgtgagaggcagggcagtggagagggaaaggcagaggcagatttgagagatacaaagactggagaattggctgagcttggagattaattagaaacaagaggttctgagggaagagcccagaaagacaactggatttacattttttttttttttttgagacacgatcttactgtcacccaggctggagtgcagaggcacaatcttggctcactgcaacctccacctcccaggctcaagggattcttgtgcctcagcctcccaagtagctgggatttcaggtggacaccaccatgcctggctaatttttgtatttttagtagatatggggtttcgccatgttggccaagctggtcttgaactccaggcctaaagtgatccagccgcctaggcttcccaaagtgctaggatttcaggaatgagccaccatgcccagcctggatttctaagtgactgcataaatgaaggtaacatttttgtcaaaataatctctccacacagatgtatgcacataaaatatacctatgagaataaaggagaaaactaacagtagttacctctagcaaggtgggatgagaagtttcctgtacctaggacacttcgatatttcaatttctaaacctctgtatgatttcaaatgtttagcatgacattttatgagtttaaaatttgaaagaaggccgggcatagtggctcatgcttgtaatcccagcactttgggaggtggaggcaggcggatcacctgaggtcaggatttctagaccagcctggccaacatggtgaaaccccgtctctaccaaaagtagaaaaattagctgggtgtggtagtgcacgcctgtaatcccagctactcaggaggctgaggcagaagagtcccttgaacccaggaggtggagttttcagtgagtggagatcgcgccactgcattccagcctgggtgacagagcgagactccgtctcaagaaaacaaaacaaaacaaaacaaaaaattgaaagaaacaaataaatcaagaagcatctaaatgccacagaatatattagattgatgcaaaagtaattgtgatttttgccattgaaagtaatggcataaaaacacaatttcgttcacaccaacataatgcataacataaactaatgcttaacatatttcaagatgacattactgagtcattatgaatttttaattacattatgaagtttagttacttttgtacatagaagaataaggaaagaactgaagggctctgatatcttttgacagcactcttaaagatattaagtaaaacatttctcatttattttcttatctacatggatattaatatcctaaatttttaaaggatagtttcatgtccagagaatctaagccattgttcaagctcagaaatggcagcggtaaggtttgaaccctggacagcgcttgcactatgtcagtctatggaagtcaaaagggaggtcgtgttaactgcataggcttataggcaatcttcccttcagaaagcccttctggttggaaatctgacagacagttctgctagggcaaaggaaatagcattttaactctgttcttaccttaattctaaagtacatgaataacactttgctcttaaggaaggccttttatctgagtctttcaaacactgaacaaaaccaattattacccaccctccttcatggttcaaagagaagattttaatccctaatttgctgacagagagacagaagccggcaggaatgaagtgatttactgagggtaacacagtctatgaaagcgttcaagaataaccctgagggcttgtgacaaaagagcaattgccttatgcaattagcagtgaattcctctgtcctaatcactgcatcttactgtttcccatgcaaagtttaagggaactaaacttctcctctttcctttcccaccataaatcggacgtagtgctttttatgtaaatgtactttgcaaaaatgtagatccctataattttaccttccatctgtttcatctgtttttaaagatcttactgcagaatttcccaaacactttgaatggggtggaaaagccccatacaagaactcagatgtcctgctggttcctttggctacaacatcaaaactcttgcagaaatgaaacaaaaaaaaagtatgcttctgttcttcatgaaattgcccaaggagggtgtctggataataagccaaacatggagggtggggattaactgcatttgagatgtgactgcagagcacattaagctgctttgctctacaggtgttgctgcttcctcacaagctccactgtgatggatacaacctatgtgacccccagtgagtcacacctttttaaatctcctcatcttgagtgctgagatgtgcagtgtaaggtcccctgagcaggctgcaccatggtcaagccatcatgacccctgtgacccacatgtacacatccagaagtctcaaattctgggagccagaaagtctgggacaacaggaaaaccactaaagaagaaaaatggctagtacctgtcttagctgattaggtaaccctgcgacattctaccattctagcatgctctaccctaactgatcaatcaacctagtgacactgtgctctatgacccctcccaccttgtgataatgcaccttgcaaccttcttcccctgcccacaataaatggcccctaactgtaactttccactgcttaccctaatctatgaaattagctccaatcccaccaccctctgctgactccctttttggactcagcccgctcacatccaggtgaatagacagtcttgttgctcacacttagcctgttcaggttgtctcttcaattagatgcgcacataacacagaggtgatgggatgagatgccacacccatgactgtactacccattagaggactagagagaccctccgttgttggctttgaagaatccagctgccatattacaagggagcttgcaagaggaccaggtggaaacggactgcaagtagcctctaggggctgcgtggccctacattgacagccagcaagaggggaatttcatatgtgcaaccacaaagaattgaattctgccaacaaccacaggagcttagaaaaggatccacgatccagaaagaaatgcagcccaatcatgattctaactgtggcctcatgaaactccaaccagagcacttagctatgtcatttctgaactcctgatccttgggacagtatattatgaatgaatgttttctaaatccatttagtatttggcaaattgttacacggcaacagaaaatgaatgtaaacatctttctattttagataaaaaaagatagtaacataacatttaatgtcaaaaggacattagcaggtattaaagtgatgccttaatgatatatttgattttaatggataattttacctattataatccagagcaaagaaagaaaaggaagcaggggaagattccatagaagaaggaaccagctgtctgaagcatagaggtctaactatttgcaactcatcctgtgccttaaaaatgggaagactaggttatatattattaattaatgacagaaaaagccaaagcagcattggcatcactatattaaaacttagtgccccactatatcatttacaaccacctaaaattgaactgaagctataactggtttcgaaagagtgcagcaaagcaagattatgaaacatatatattgatatttgtgtgaccttttgaccattggttctcaaatgaggctttctgttcactgtctgttataatgtaaaatatttttaatagattaaggacttcagattaaaaaaaagaagaattcctaaacatcatcccagttaactgaataaaaatcctcaaaaataagacctcttacctctctccaacccctacacacacatacgcgcacacacaacacacacacaccaaagacttcatgcgattccaatgtagctagcctagtcattggtatttgtcatgatagagctcatcactaataggtcatttctttttgtgctagaagcaccttgtatatgttatatatctagttcaatggttctcaatcttgcctacacaatataattacttgaagagctttataaatcctaatgctgaagctttttcccagagcaattacatcagaatcaccaagcatagtagccactatttttaatttgtaaagctccccagatggttgcaacgtgcatttaattttgagactgctgatctgtagataatagtttgcattttctgcatccttcctaatatataattatgtagtccaaaacccaaacactgcctgggaagtatgtaggccaaccacgactgtcccactttgatggaacatacaactgaggttgaccatttggggccatactataataactcctttttattgaacttcatgtttattatatttatttctttaaaaaagtgcaatctagttatcattatcccagtttatagacaaagacacatcgtctcctgagtcagagggaactgcccaaatgagtaacatgacctgaggctgagtgacaccgaagcttatgataactgcacaaaaccagtgattctcaaagtgtgggctccagaccagcagcatcagcatcaccttggaacttgtaaaaaagaaaatgcaaattctatgacccaatcccacctctactaagtcataatctttcaagatggggcccaggaatctgtgtcttgacaagcccttcaggtgattctgaggctccttataggtggacagtgtactgtattctgtctctatcagctgctcacttttgagactcagaatctggcaagagacctaaaaatgtgtgggagcctcagtgagtaagcctgtgtgagggaggagatatttctctcactatcttcccttcctctcatttccaatctatattaacaatctatgttgaaaatgctaggggatgtatcagagataccatatgggaaaaaattggtggagttatgctggtcatatttacttgcaggggtgcctggctatgttgagctactttcacacaagtgtgaccattttaatatgttgacgaatggtttatcctttgaatcacagtatggagagttttaatagtttcattaaaaatgaatatcccaactgtttccagggaaatgagtttgtgatcttaagggctttgaggtaattggtgtttagggaaccaaggcagttggtttgctttcttggatggaagctgcttcagcttactaccatgctgtaaaacccaagtgctgctgacctgcttagtgtatttcggctatgcttagggttcatttattagaattgtacatttgactagggggaaataaaaattaaaaggccacttgtgtttgatttatgagagatgtcgattaatattttctgagcaaactgtgaagtcctttcttttaaagaagtatataaaataggcctttggcatattcaggtctgatggaaatttgtctcatggggcagggtgagatgggagaaagagaaatcaataaagatagagaagagaaaaaaatagaggaagaggaggatggggaagagctgaaaggagacaataattcacaaggggaagagacagaagaggtgaaaaaaaggaaagcaaggaggagtgaagaaataagaggtggggtcagaaggattaaaaaaggggaaagaaaagagtttgggaaaatgggggaaggagagaaaaggaagaagagaaggacatatgggcaacaaaaaaaaacataaaataaaaaaaaataaagcaatgaatgcagactttggagcctagcaatttattgtgaagtgccacttgtattagacatgctgcagagatgctggctccaaagattaatgatggcagtaatcatgattccaatttatagcaaatgcaatgaaaggcagccagaccccaaacagagaaaccctacggggatggcattggaataataacatagcagcagtcgaggaatacagggatgctgagagattggattcagttctcctgtgttcaacaaacattctgtatctgatgtacaatccaatgttaaaaagaaaaaaaaagtctgcttattactagatctctgaattatagcaaagaagtttaggtgttcacatgaacacatttgaagttttattctgtgattcacctcctctgagcactgacttttggcccagattggtcttttacacctcctttcctttctgtccttgctgctcagtgtttttctgctgccagtggtcaataccactgtttcattgcaaatacctgctgtctctgaagcctggaaccactgcagaataggcataactactcatcctctttcctggttgtcaaaacccttttccctttatgcatgtttatttgtatgtattgtcttgatatattacctatcagattcctttaatcagtggtctgtgtgtgtggtgagcactcatctccattataatctcctctgcccccacctattgccacgaagtcctaggtctttgcagatgatcaaattttggagaagaaacaaatttactctgcataatagagggagaaaaacttagaaagcccagggcaaggagaaggggctgaggagcagaaatgggagaaagacagactccattcattcagacagatggtggaaacttgtgtgcaatgcgcatgcagaaaccctataaaaatattctgcagtgtcaactaccggtatgaattctctgagtaaattgctgttgtggattccaaagaagaggtagagattcatatctagtctgcataaggttggacaaaggcagcagttgtggtggtcagatgtgaagaggatggcattagaagaaatccttggacatcacagacttctacacgcactggaactggggttcttaggggctgggtttcaaaaggatcaaagcaatttaatttggatctccaggggtgcctgtagctactttggtttccatatgtataagaacaaactatatgttgggatgtgtatgctatttgatacataaacatttgatgcctttaaggatgaactgttttcagatagattcatgacagcaagttttctctccctattcagaccataagctccttaaggatagaagtgtatcttctctggcttttgaataacctgcagcatctagtttaacccttagcacatacaaagtatttggtaagagactgtgtctcatagtcagcctggatccactcactttctctcaccccaccctctggggttttctgggctctcattcccttttgaagatggttcacccaggagggagggtcatctgcacacctggattgcagagaaccaggtacagtgatgacctacagacacctgtggtttacagacattggcagcatggttttttaaactataaaagttacagtaattatcctccaattccaggaatggaatcccttgataggcctcaatctacattcaagattcaagtcaagcaccagcctgtatttaaaaactaaggaaacaatggaagtttaatgaaattatgtcattatagttgatgaagagaaaatatttcaaccaagaactgaattgaataaaactttctcagaaactctttgtttaatgggcaatcacagtatgccagcatgggtgtgccacagagaatcaaagtccacagatactgattatattcctatctgggaaggatcagtatgaaatatacatatgatggggctctcatagaatgggatattttcccccttttcctctcatttctcaatgctcctctgggaattgtgtgaaggtaaagtcaaaaagaaagttcttacattcttaaatcctctgtaaaggatctgaagctctttcttggtaaatttgctctgggcttccagaagctcaagggcttcaggccgatgcctgacggtggccatctccagttcatcttccacgctgtctgtggaggaaaacaagaaagagtcttaggaccagccactgctcaccgatgcttacacagagcaacaaaggaaaacggaagaacatgtctgctaatgtctgtgactgtccacagaggaaggaccctcacaatgcctataaggcctttacatttcccagtttaagcgtattaagctaaaacacttgtatatgatttttttgcatattcttgtcattaatgtagatattacaaccctagcattgttttaagacaacaaaaaagagcacaggaatttatttcagataatcagtggattatatgattacgtcaaacaaaaagtttaagtagcaatatatattactctataaatctaacagtaacatatatttcttttttccccaacgtttaagttcagaggtacatgtgcaggatgtgcaggtttgttacatgggtaaacatgtgccatggtggtttgctgcacagatcatcccatcgcccaggtatgaagcccagcatccattagctgttcttcctgatcctctccctcccccaacaggtgcccagcatgtgttgttccctggcagtgtccatgtgttctcatcaatcagctcccacttacaagtgagaacatgcagtgtttggttttctgttcctgcattagtttgctgtagagaatggcttccaactccatctatgtgcctgcaaataaaatgatctctgtcctttttatggctgcatagtattccatggtgtatatgtaccacattttctttatccagtctatcattggtgggcggttaggttgattctgtgactttcctattgtgaatagtgctgcaatgaacatatgcaggcatgtatctttataatagaatgaattatattcctttgggtatatacccggtaatgagattgctgggtcaaatggtatttctgcctctaggtctttgaggaatcaccacactaccttccacaatggttgaactaattcacactcccaccaacagtgtaaaagtttccctttttctctacaacctcaccagcatctctagcatttttaaggtatagttagaaaaacatagaagatcacaaatagtccaacctggaatttgtttctatataacaaccactagttataaacaatggaattgtcatttaataataatcagttttgtgccctatgtaaaatgcaactacaagatagcctctgataatgttcactaaggattccaatgaaatcagatattttgcacagctacttgggaggcggaggtgggaggactgcttgagcccaggaggctgaggctgcagtgagcagtgatggcaccactgcagtccagtttgggtgacagcatgagaccctgtctcaaacaaacaatcaaacaaacaaaaaaaatagaaccttagactctcagaatggaaggacatctgaagaaagatataaggagatagagaaagaaggaaacctccctaattcattctatgaagcatcaccctaataacaaaaccagcaaatgacataaccaaaagagaacactacagactgatatccttgatgaacatagatgttaaaatccttaacaaaatactcactagctgaatccaacaacatatcaaaaagataatccaccatgatcaagtgggtttcaaaccaggaatgcagggatggtttaacatacgcaagtcaataaatgtgatataccacataaacagaattaaaaacaaaaatcacacgatcatctcagtagatgctgaaaaccattcaacaaaatccaacattcctttatgattaaaactctcagcaaaattggcatacaaggcacataccttaatgtaataaaagccatctatgacacacccacagccaacataatattgagtggggaaaagttgaaagcattccctctgagaatggaaacaagataaggatgcccactctcaccactcctcttcaacatagtattagaaatcctagccagagcaatcagacaagagaaagaaaacaagggcatccaaattggtaaagaggaagtcaaactgtcattgtttgttgatgacatgattgtttaccttgaaaaccctaaggacttctccagaaagctcctagaactgataaaagaattcagtgaagtttctggacagaaaattaatgtacaaaaatcagtagctcttctatacactaacagtgaccaaacagagaatcaaatcaagaactcaacccctttacaatagctgcaaaaatataaaatacttaggaatatacctaacaaaggagtcaaaagacctctacaaggaaaactacaaaacactgttgaaagaaaccataagtgacacaaacaaatggaaacacatcccatgctgggtagaatcatggatgggtagaatcaatattgtgaaaatgaccatactgccaaaagcaatctacaaattcaacataatccccacagaataccatgattattcttcacagaattagagaaaacaattctaaaattcatgtggaaccaaaaaagagcccgcatggcctcatagaaaaagcaagactaagcaaaaagaacaaatctggaggcatcatactacctgatttcaaattatactataaagccatagtcaccaaaacagcgtggtactggtatgaaaattggcacatagaccagtggaacagaatagataatttggaaataaacccaaatacttacagccaactgatctttgacaaagcaaacaaaaacacagagtgggggaaaggacacccttttcaacaaatggtgctgggataattggctagcctcatgtaggagaatgaaactgggtcctcttctctcaccttatacaaaaatcaactcaagatggattaaggacttaaatctaagaccagatactgtaaaaattctagaagataacattggaaaaacccttttagacactggcttaggcaaggatctcatgaccaagaacccaaaagcaaaagcaaaagcaataaaaacaaagataaatagctgggacctcattaaactaaagagcttttgcatggcaaaaggaacagtcagcagagtaaacagacaacccacagagtgggagaaaatcttcataatctatacatctgacaaaggattaatatccagaaagtacaacgaactcaaatgagtaagaaaaaaaccaacaatcccatcaaaaagtaagctaaagacatgaatggacaattctcaaaagaagatatacaaatggctaacacacatgaaaaaatgctcaacatcactaatgatcagggaaatgcaaatcaaaaccacaatgcaatactgccttactcctccaacaatggccataatcaaaaaatcaaaaaacagatgttggtgtggatgcggtgaacagggaacacttctacattccttgtgggaatgtcaactagtacagccattatggaaaacaatgtggagattccttaaagaactaaaagtagaactaccatttgatctagcaatcctgctactgagcatccgcccaaaggaaaagaagtcattattcaaaaaagatacttgcacatgcacgtttacagcggcacaattcacaattgcaaaatcgtggaaccaacccaaatgcccatcaatcaatgagtggataaagagactgtgatatatttatataatggaatactactcagccacaaaaaggaaagaattaatggcatttggagtgacctgaatgagattggagactattattctaagtgatgtaactcaagaatggaaaaccaaacctcgtgtgttctcactgatttgtgtgagctaagctatgagaacgcaaaggcataagaatgatacaatggactctggggacttgcggggaagagtgggagacaggagagggataaaagactacaaatattgtgcagtgtatacgtgggtgatgggtacatcaaaatctcacaaatcaccactgaagaacttactcatgtaaccaaataccacctgtaccccaataatttatgaggaaaaaaagaattgaaggacatctgttcattttacaagtaaagtgaaaaaagaaatcagatattttgccttgggctacaaaataaaatgttcatattaggtgctgacaagggtaaagtaaccagcagccagttggtttcatgggtacatactggatggttgggggcctagaggatattctatttaggtccattttgtagtcaatagagtcaataggtatagagaagctttaaaatattgtactttgctttgtgaattatgtttacgctataatttctcaaagatgttttatgcaaaaaggaattttgtgcccatagatgtttggaaaatgctgtgaactttaatgtagttttgtcacaaaatattaaattatataggtttgcgaagacctgtaacaaggagtcttgtttaactttgcgtaacccaactgaccccaaaggtatttgtccatagaacctttcctggcccaagtaacatctggtaatatctgcacatttgccctagggtcatgtaagcacaagtctggaggatttggaaatatattagggttcaggtgcttgtgtctcaaatatcatccttcagtccagctcctttgaagtggggtcagatagtggcctataggaattctctctgttgtgtaaaccaatccacacctcagatgaggaacttagcaggaataaaaacatccaggctcagtatgaagccttggcttcccctttctatcctttcttcttgactacagattggagactcagagagaagggtctaaggataacagtcagctcctctcatcccagagccactaggaccccaatcccttgtcccatgggtcagttggaaatgtagtcctttttgccaaagtcgagccatttttgacactaatattgctgcctcttgctaacatctgttcctccttactactctgcctcactgagagcattgaggggccaaagctctcacttggcaaggaagagaaggtgagtggcaccctaatcttagcatatcttaattattgccctcaaggagtttacaaaaaaaaaattggtgatgaaacaaacacttggagtggctatatttgtgaaaatgagtaataggagatgaaaacaaacatttgctttgtactttttatattataataacttatctggaaagaatgaaatggaaaagcttcagaatagtgacggatgaataaaaataatagaaaaggacatggaaagatgagaaggctgacaaggataaaattgatgggataaaattgagctgacaaggataaaattgatgggaaagtaagtagttgtgctcctaaagtatgtgggaagagctcaaagtagctggaaaaaggcacctaggcattaacaaattgatctgggctttatggggaaaatcaaaaaagccaaaatccttcaattttctccttcattcatttgaacaaatgggttgattctattcaatgggtcctgagatagaaaagatgatggaaaatgttgcttttagactgctgttgatccaatgacttcaactatgttgtattattgtatttgccaatgcaggagtaaatagcatgcaatagacctcatgtaaatagataatatcgaatagaaagcctgtgctttcttgaacaatgtctgatgtaatcttcttttgaatcatttatagtgcaagttcttcaacctaaaatgttccactttccttttccacctgttaaaatgtatatatctttcatgatccaatttaaatataagtgtctcatttctgaagcctctctggattcccatactatgcaaaattggtgaccccctggtcatcgttcccacactctggttcttgtatagcatgtaaaacataacatcatgatctgctcatgtttgttttctccattgtgagttttttttgcagacaagatcaatatcttacatgtcttgtttatcctctgaacctaacaggaagtctgatactcctttgtcacttaagaataatctggtaaacaaaggatattcctgctcaactttctgatcctctccaatcccttgaatatttgctgccctatagggaaatatttttcagactgaaatttgtgggctgttggtggacctcaaatgtcttcttcagaatcactatgttctctatttattgtactgggaaatacagcaaaagtagaggggattttaattaaattttctgagcagtctttcagtcataacataaccttgtctagacctagtgaccctcacatgggacagaaccaaaacagcggattaaattctgggcctttgtatcgggcagcaatctgagctgtgctacaaatggagtttctttctctgcagatgcaaagtctgagacaaaagacacagggctggaggatcagtataattaagtgtgcgtgataggatgatcatcacatgcagtattaaaaaaaaaaaaaaaacgcccttgaagtgtctgcctgtgggctctcttgcttttccagctgtctggtaccttacttcttaatgactcctacctgccaaagggctgtttctatttctaggcgggtgacaggctctaaaaacataactgaaatcatcagcaatcaccagcatatgataagttaaaaaagcaacaccaccgaacccaatcaactctgattcttggaggcaaactatggggagcacggcatgatcccacgtaggactgcgaattctcattgtgactcagccaccttgtaagagcctgtattttgggtggttttaacccagtgcctaacatttattgagcccttgttgtatgccaggagatgggcaaggtgcttgattggcataatcctaatcctcacaataaccccagagtgaggtttaattgtttatttttcacatacatggagactgagtctcatggatgtgaagaaattcacaaccagaagtcaaatatgtgtttatatatacataaaaacataacatatatatctcctatgcatatatatgggtttccatatatatgcatagggacaagatttacacccaggtctttgatgccacagcttatgttcttcccacttcccactttgccacagtctcttttaataccagcagaaataatgatacaaataatgataacctctcctctcttattttgtcaaactcctcagaaaagttaactgtattcattagatccattttcttgctctctccttaatctactgcagtctgacttctggtcctatggtggactgaattgtgtccctcctcaaattcatatgttgaaggtctaaccctgtatttggaggtagggcctttaagaagatagttaagcataggccgggcgtggtggctcacacctgtaatcccagcactttgagaggccgacgtgggtggatcacctgaggtcagaattcgagaccagcctggccaacatggcaaaaccccccatctctactaaaaatacaaaaaattaggcgggtgttgtggtgggtgcctgtaatcccagctactcgggaggctgaggcagaagaattgcttgaacccaggaggcagaggttgcagtgagccgagatctcgctactgcactccagcttgggcaatgagagtgaaactccatctcaaaaaaaaaaaaaaaaaaaaaaaaaaaaaaagaggaagacacgaggaatgtgggcttacagaagaaaggccatgtgaagatggagtgggaagatggctcacagctggtaccttgaccttgaacttccagcctttagaattgtgagagaataaattcctgttgcttaagccacccagtctgtggcattgtgttatggcagccctagcaaactaatatatctacctatattcaaatgacacacaacactgataaaagcaggtcttgttatccacaaagtttgcacaatgagtgctgggcagtttgctagccaattatgtcatttaatcttcacaacatctttcaagagaaggattatcatccctattttataaatgagaaaattgaggcttggagagtctaagtaacttggccataacccaagcaactcttggccaaatggctacttagtaaacaagatgaagacaagtgtctccagcagcccaaagtccaggttactgagcactatgctgggaatgttaatagcaaccatcaccctatggagaacttttgctctaagcgtggttgtatattatcccattttaatacagacagaagttcagtgagatagctacattttacaagaagtcatgtagccctcattttacaaggagtaaattgggactcacatttcttaaataacttactcaaggtcatacagcttacaagtgacagggctgggatttaatccctggctttttaacaccaaagaccatgagcttagtcaatatgctactttaagagatggcaacaattaaattactttgttcaaaatcctaggggataaaagattttaaatcacaaactagctggctgctgagcctccaatgcctcaatttctttccagggaaaatatgccggggcaccttcaggagatcaccagaccagcagacaaagctgtgctgataagaaacacatggtagaataaggtacgaagtgatgggatctcagagctggaaggaacacaggaaactgtttgtttttctgcattttacccctgagaaatttagatttgggaaagatgaatgtttgtttgagacaaaaaccagaaccagatgggactctggcctctggagttatctccaggccatgcagacatatcatcactcaggtatcttgcagaagagccaattcaaatgcgcatttgcatcctgagataagcgaaatacaaatagtattttaattcatgtatcttctaacaaatttaattttaatcagacaacaaattcccaaacccagacaccattgagcttcctggctgtgtctttttgtcctttgttctttagatttcagtctctcagggctgagtttgtcctaagtctgactcaacagtcccctcaggccatgacacaattgggctagaaattggaattcaaatcatctaggaacaacagaatgcgttttaaaaatagtcatcgttctcctctttctcacaacttctcttaaaatacagtagaagcttggtacagctcaactcgtaattatgcaaatttgactctaagggcaaatcatgccatccagaacactactacggaacatcttgccttacgaacaaatatgagcgtgagtcctaccttttgacgacatgctttggaaacaagtcttctaatgcagaaaacaaataatattatgaagaataatgtcactttttgagaaagctgattcagaactcaggccatgtgtgcagagatgagtccttgcctataaagcatgaaacactgtgaggctgttgccttgttcttttatttaggtcctgccaaaatacgggaaggattatcttatttggcacactgaaggtgctccataagagaatgtgaaataaataactacttgaagcattccaagaatagtgagtgtatctacagcaggtcccatttcttttttttttcttctctttttttctttttttgagatggagtctcgctcttgttgcccaggttggagtgcagtggtgcaatcttgactcactgcaagctccgcctcccaggttaaagcgattctcctggctcagccttccaagtagctggaattacaggaacgccccaccacacctggctaatttttgtatttagtagagagggggtttcactgtgttgattaggctggtctcaaactcttaacctcaggtgatccatggacctcggcctcccgaagtgctgggattataagcgtgagtcaccgcacccagtcccatttctaaatacaacatgactcttctttaaaaataaatgtatccatttgtcattctaaaaagattataaatattgtaactttaaaattctatttgagctgaaattaatttgtctagacaaaaattcagcctgcttgacttatattgctttatctcattgataaaaataccctctgagccattactcctaatgtttacattttattaaattggccgaatagtgagttgatccatatggcaataacataatgaggatgatcactttctaatgatatcttatgtattattaaatatttagaagcttggtccagtggtggatattggaggaagatttccaatgctgaaagattcttgaccatagcattagatgctattcctgagaacttctaggataaggaggtgatgctattgtttgtttaatgttcaagtctgatacatcaggacaaagaaaaagctgcctggaggaagatttccaaagcgaattttcatggcactgatataatttatttccacccttcttttctactgcaaaaacttgtagagggatgacaacatactcaccattccattcctcggttccactgctcacaaagctcaaagagggtggcatgataatcagctgaggaaatagtttcttgggtggaggaatttgctgaagtctgcacagctgtgcagctgatgagtgtgggcacggggagccaggacctgccccaaacctgtctttccccttcctgttatatcatttgacctccctggatagagagtttaaactggggccaggccctgtaagcaactctttaaactttgacaattttaaatgctttattgcaagaatgcagaggtctgggaactcctttgacttttcctgtctttattactattcacccatccacctaccaagagttattttcaggtgcacatggagagtatagaagcaattaattccaagctgatcacacacaggctgcaagtagagagcagtcaatccatttgaaacactgtgggagtcctaggccttcccagaccaacccgagcaattggaatcctgatgttttagttagtttgacacgtatttctgcaaccctggccctgaatgtatgttagaaccaaaatacaaaaacaaacaccaaaaaatgaacaaaaccatttataattagtactttatcttacttaatatttgtatatcatattgaaaatgaacagttcttggaaaatggccatttagtttgaacatcttctgttacaggtacttgttggcaatgacattgcaatttccattctaggagaatgagaattgctttgcaatttcataattgaattcaatcacttatgaaatataacaacccagtggtgaacagctgaagctatttgccacagcacttatgaaatagattgtctctaccttatttacaaacataaataactcttcaacaagcttagattttaaaaaataatcacctaattggaatgcttattatcagcattaaccatattattactacagcatcatgaatggccccttatggtaggagttattattattattattattattattattattattattgagatggagtcttactctgtcacccaggctggagtgcaatagtgtggtctcagctcattgcaacctccacctcctgggttcaagcaattcttctgcctcagcctcccaagtagctgggactacaggcatgtgccaccacacctggctaatttttgtatgtttagtagagacggggtttcgctatgttggccaggctggtctcaaactcctgacctcatgatccacctgcctctgcctcccaaagtgctgggataacagacatcagccactgcacctggatgagttattattttttaggtggtagggtcttaattgatttttggtaaataagaaaaacaaaaattatactgccagtcattatgctcagacagaaaatctacaataggaatgctgagggggcagaggaaggaaacaagaaatttaattgaacttacacataaagacagaccaaaagagattgatatactagtcaggaaaggcaaaagctgagagggattatgagcaaagagaaaaattttaaaaagcaatggtatgtggagagagatgaagaaagcccagattagttcactaaattaaaaatgccctatcaaaggagtgcctcaaactttgatagattttctcttagttgtcctaaaaatcaataacaagacacacatatgtgtatgttcattacaacactattcacaatagcaaaggcatggaatcaacctaaatgcccatcagtggtagactggataaagaaaacatggtacatatacaccacggaatactatgcagccataaaaaagaacaagattatatcatttgcagaaacatggatggagctggaggccattatccttggcaaattaatccaggaacagacaaccaaataccgcacgttcttgcttataattgggagctaaaatataagaacacatggatacatagaagggaacaacagacactggggcctagtggaatgtggagggtgggaggaggaagaggattaggaaaaataactaatcagtactaggcttaatgtgactgtgcagtgggttcaccttacccactgcctagacagagccaatttatcaagacaggggaattgcaatggagaaaaaataattcatgcaaagccagctttgtgggagacccgagttttattgttactcaaatcagtctccctgagcatttagaggtaggagtttttaaggataatttggtgagtaggggctcaggaggtggggagtgctgattcgtcagtttggagatggaaccatagggggctcatagtgcggttttcttgttgtcttctgttcctgagtgggatctcagaaatggttgactcagattatcggtctaggtggtatcaactgattcatcaagtgcagggtctgcaaaatatctcaagccctgatcttaggtttacaatagtgatgtgatccccaggagcaatttggggaagttcagactcttgcagccagaggctgcctgacccctaaactataatttccaatcttgtggctaatttgttagtcctgtaaaggcagactggtccccaggcaagaagggagtcttttctagaaagggctattatcaatttgtttcagagtcaaaccatacactaaattctttcccaaggttagttcagcctacgcccaggaatgaacaaggacagcttaaaggctagaagcaagatggagatctctttcactgtcatgatttcctcagtgaaacttttgcaaaggaggtttcattaatacctgggtattttcgaccagacaaaataatctgtacaacaaacctctgtgacacgagtttacctaataacaaacctgcacatgcacccctgaacttagaagttaaaacgaaggaagaaaaagagcaaagaacaatcactaatatttatagcatttgttttgtgtaagctctctctttcatgagtgtatatgtatatatatacacacacacatacatatacatatatacatatgtataactagatatacgtacatgtaaatgtgtgtatgtatacatacatatgtatgtatacgcatgtatgtatacacatgtatgtatacgtatgtatgtatgtatatgcatgtatacgtatgtatgtatacatatccatgtatacacatgtatgtatacatatccatgtatgcatacacatgtatgtatacacatgtatgtatgcgtacatatgtatgtacacacatgcatgtatatatgcatatatatgtacacatatgtatgtatatatgcacacatatgtatgtacacatatgtatgcatatatgtacacatatgtatgcatatatacatacgtttatatgcatatgtatgtaaacatgtatgtataacatgtatatatgtatgttatacattttatatatacatgttatatatatataacatatatatacatacactcataaaatccccatcagcgtactataaatgctatattcttgttctgtagatgaagataccaacacagagagactaagtaacttgctcatggtcacaccataacagagtcagggaatggagtctgggaagtctggttccaggattcatgtaataactattcagctgttctgcctcccccagagcaggagagaggatgatgccccacttatctagaattcatgcacccaaataagaatcagaaaattagtagcaaaagggctctaagcagaaaatggaactctgtgagaattgaaaggggtattgagtccagccccttaactttgtaagttcatgtcacatacagagccttagctacagtggttgtaaatcaaaaaccattaggcatatcagtggcagaactgggcctaaatcttgatctttttcattcctactgcagcactttgtcagatgcctgcctcagtatcttttatggataagagtgtcttcatccttactgtacccacagttttagtaagcttccgattccacatcagaagcagatactgataatggagaaggagcatacactggaaggagtccatgagccacagttataatacctaattttcaccactggctcttcattatcatatctgagcaatgtgatattctgtgtataaatattgtcaccctgcttttatagataaagaaatcagggttggaagaaaggatgtaactgatgaaggacatagaaataggacgttatggagtcaggacttaaacccaagcttactgactctgaagactagaagtgactgcaggttgtctgagagtaatggagggaacataaagttgaaaaacatcataggcatattagagaaaagagtaatgacaaaagtcagtggctaacttattctttaagaataagttctaaccttattctttaagaaaatgttttattctgcttactttattttagaaggtaacagaaatgtgatacatttttaaatattattaattaaaattggcagcttattcatagtagccaaaatatggaaacaacttatgtccatcaataaacaaatggataaagaaactgatatatacaatggaatactattcaacattaaaaaagaagatcctactatttgtcacaacatgaatgaacctggaggaccttatgttaagtgaaataagcaaaacgcagagaaagaaaaatattgcatgatgtcatttacataaagaacctaaaaaaatgttgaatacacagagatagagaataaaacaatggttaaagtggggaggaactagggagatgtaggtcaaggtatagaaagtaacatataggatgaacaagtctagagatctaaattacaacatgaaaattatagttaatattgtatttgtgatctttgctaaaagaatagattttagatgctcttgctacatataaaaatgggtaactatctgagataatgaacatgttaatttgcttgactacagtaagtgtttcaccatctatatgtacatcaaaacgtcatgttgtacaccataaacatataaataacattttaaaacgtttatacaccttctgaaattgagtcagtaataaagaacctgccaactaaaaaaagctctggaccagatggactcatagctgaattctaccagacatactaagaagaactgataccattcctactaaaactattccaaaatatcaaggaggaggagcccctccctaactcattctatgaagccagcatcaccctgataccaaactctggcaaggactcaaccaaaaatgaaaatttcagacaaatatccctcatgaatacagacaaaaaaatcctcaagaaaagactagcatattgaatccagcagcacatcaaaaagttaatacgccacaattaagtaggcttcgttcctgggatgaaaggttggttcaacatatgcaaatcaataaatgtgattcactacgtaaacagaatcaaaagctggaacattatgatcatctctatagacacagaaaaagctttcagtaacaccctatatccttttatgataaaaacccttaccagactaggcatctaaataacatagctcaaaataataagagacatctatgacaaacccacagccaacatcatactaaatgggcaaaagctccaaccattcttcttgagaattggaacatgacaaagatgctcactctcaccactcctattcaacatggtattggaagtcctagccagaacattcaggtgagagaaagaaataaaaggcatttaaataggaaaggaagaagtcaaactatctctcttcactgatgatatgactctatacctagaaaatcctaaagatcctttcaaagggtgactagaattgataaacaactttagtaaagtttcaggatacaaaatcaatgcacaaaactcagtagcatttctacacaccaacaacgtccaggctgaaagtgaaatcgagaacacagtctcaattacaatattcacaaagaaaataaaatacttagggatatagctcacccaggaggtgaaagatctccacaaggagaacgacaaaatactgttgaaagaaatcaaagtgacacaaataaatggaaaagcatttcattcttgtagactgaaagaatcagtgttataaaaatggccatactgcccaatgcaatttatagattaaatactattctagtcaaactactaagaacattcttcacagaattagaaaaaaagtattctaaaattcatatggaaccaaataagagccagaatagccaaagcaatcctataagcaaaagaaaaaataaaacagaaactaagcccaagacatcacactacctgattttaaactctactataaagccacagtaactaaaagagcttggtactgctatacacacagacacctagaccaatgaaacagaatagaaaacccagaaataaagtcacacgcctaccaccgtctgatctttgacaaggctgacaaaaacaagcaatgaggaaaggactccctattcaataaatggagctgggataactggctaactatacacagaagattgaagctggacccccacctttcaacatatactaaagttaactcgaaatggattaaagatttcaatgtaaatctcaaactataaaaatcctggaagacaacctagggtatacttttctcaacatcaactgtggcaaataatttttggctaagttcccaaaaacaattgtaacaaaacaaaaatagacaagtgggacctaattaaactcaagagctcctgcacagtaaaagaaattatcctacacttgatcttcgtggatgaagctggaggccatcattctcagcaaactatcgcaaggacaaaaaaccaaacactgcatgttctcactcataggtgggaattgaacaatgagaacacatggacataggaacaagaacatcacacactggggcctgttgtggggtggagggagtggggagggatagcattaggagatatacctaatgttaatgggtgcagcacaccaacatgacacatgtatacatatgtaacaaacctgcacattgtgcacatgtaccctaaaacttaaagtataataataataaaaaaaagaagctatcaacaaagccaacaggtaacctacagaatgggagaagatattcacaaatgatgtatccaacaaaggcctaataccaagaatctatacagtagggaacttaaatcaacaagctaaaaccaaataaccccctttaaaaacgggcaaaggacatgaatcaacatttctcaaaagaagacacagaggtggccaacaaacatgaaaaaacactcagtattagtaatcatcagagaaatgtaaatctaaattacaatgagataccatctcataccagtcagaatggctattattagaaagtccaaaaacagatgctggtgaggctgcagagtaaagggaattcttacacatggtgggaatgtaaattagtccagccactgtggaaagcagtctggagatttctcaaagaacttaaaacagggctaccatttgacccagcaatcacattactgggtacacacccaaaagaaaacaaataattctaccaaaaagacacatgcactcatatgttcatcactgtgctcttcacaatagcaaagaagtggaatcaacccaggtgcccatcagtggtagattggattaagaaaatgaggtacacagacaccatgaaatactatgcagccattaaaaaagaaggaaatcttgtcctttcagcaacatgaatagggctggaagccataatcccaagcaaattaacataggaatagaaaaacaaatactgcatgttcttacttgtgagagttaaacattgaacacgcatggaaataaatatgggaacagtagacactacagactactgggaaggcgggacattgaaaaactacctattgggtactatgctcactgccaaggtgacaggatcctaattccaaacctcagcataatgcaatactcccatgtaacaaatctgaacatgtacctactgtatctaacatagaatttgaaaaagaagaacattactgtaaagagatagacatacaggtaatgtatttatgcaaaatatcatgcctaattcataagatgttactgtgttgccttagaaagtaggcagtacacagatggaattgattacctagtgagttaagcagagtttggataagcatagttataataaatttttgctggtatattagggggatgatttgcagctaatatcagtgatgacaaaagtattctgcactaaaacatttatccatctatgtttaaaaaagctattaggaaaactgagcagtgatctgggttttgttatgttccttctacttttaacctagtttcctccttggccttaattcccccacatgttcaatggcatagaaatagacaaaaaagtagttaatattatagaataaggtaactgtgggcattaaatgagatggtatatgtgtctggcacatagtaaacattcaattaatgatattgttgttcatataatgagtagtagtattagaaatatttgcagtaatatctagtgttaccttcaacactaggagcagaacagtgcctgggagtgctaattctgacaaattattcagttcctctgagctttccttcttgggtctatttcccacctctggctggacaatgtgtttaatgtttccaagccttaattttaaaatttataaactggggataatatttgtatcaatttcttaaagttgttttaagagattgaattactggcaggcagtaataataaattacagtaatgatgactattataattattgcatacatactaattgaggtgttattctagaatatttaggagtgaggggtctaacacagcactttctgagtttgaatcatttttctgactcttgttagctctgtgtgaccttgggcaaagtgcttagtctatgcttcagtttcttcatcaataaaaggggaagagcaatggaacctactataaaatgttgtcaggaggttgaaataaaataatgtgtataaaacatgtaaaatagtggctggcacatagtgtttaaaatacttattattatatcacttattaaaatgttctttgagataagtatgattttgcccattttcgatgggtacattgaggtacagagaagttgaataaactgtccaaagacacagagtgataaggtttggctgcgtgtgcccacccaaatctcatgttgaattgtaattcccagtgttgggggaggcacctggtgggaggtgactggatcatgggggtggatttcttccttgttgttcttgtgatagtgagtgaattctcaggagatctagttgttaaaagtgtgtagcactgcccccttcactctgtctctcccactccaccatgtgaagaagctgcttgctgccccttcacccgtccatcatgattgtaagtttcctgaggcctccccaaccatgcttcctttacagcctgtgcaactgtgagttaatcaaacctcttttcttcataaatcacccagtcttaggtagttctttctagcaatgtgagaacaaactaatacacatggcgagagtaattctgtcatttgaaaaaatctttgtcccctaaattgtacccagctgcttcattttgcaggcacttcttgctgttgaattgctaattgtgggatccactagaaaccacagctccctgaggaccttttatactcttcctgtttggaattgataggggaataaaaatcatcttttggaatagaatttgagacaataactgagctttatagtctctcatttcctcccacacaacttatgatttaatatcctgaatggtttgctattccctgaatgaagtctgaattgccaacttctgtgtttttgcttatcctatccccactaaatgaacttgccgttcttcctcctcaaccttctctgtctctattctctaaggctcatttcagtggggaaggggcttcacagaggagaggcctcctgagacattcacacaccctgtgcacttgtcacctctgatggctttgtatatcaatgatctctttgaatatctgtcatttcctctgtgatataaacatttagaggcaagagatctatcttggttatcttattaccactaatgcctagtatggcctgggcattagagacaatttattcatttattcattaaatattgattgagtgcctattatgacccaggcattggtcaaggtacaatggacattagaatgaacaaaaacaaccaaattctctctcccatgggcctgaaattctaatggaagagtcaccaattggacatcggagtggcaatgtcaagtggctggatggagacatggttctgaagttgataagcacagtctggctgaagatgtgaatatcagagtcatcactatataagtaatattaagaccatcaaactcaatgtgatcactaaggcggtatacattggcagaaaatataacagtaattctttcttttatggaatgaaggaatacatttaaaaaaaaaaattaaaagggccagggagtggcagggactccagagtaggaaagcccaaagcaggatcagcctagaaatgaccattttctaagaattacttttcctgtgggtttcctctcctggtggcatgtcacagagcttcctgttcatggtggtattcaccaacaagaaaataactgagcagcatggctgtatttaacattcattcaacacagacacagtttccacatggtctttacatattcttcatgtcttcaaacatttgcccagggataaacagtgtctctctttgagttcttttttcctcttagtccaggggcagcttgcatgtaaacatggcatccaaataatgatgcctaaactcatcttgatgtcaccaagatgtggcagtcatgtggcaaaaaatcataaaatctcccacaacattattaagtgaaaagagttggaagtgagttcagagaactcaggaaaaatgctttgcaaaacaaagcatgaaaatttactgtccagactctgctccatttctcccattagagtataatctttcatagtgtgtggtatatcatagcgatgaatccacatacaggatttctgtaatgatatgatgattttgacactgatccttctaacatctgctcacctaaagcattagtttcacactgctattgaaataaatgtgatttttaatatcctcaggaacactcaatgaagaatatgtccacctctaagcagagtctgaaaacactgtaatatgctatgggattgtttttctccccagcctcaaaggagaatggtttgctgaaagataaataaggttttatactgtcagttcatctccagaactcatcttttgttcttctacttcctctttttaatgaaaccttacaaataaagatggaccaatattaccatcaagaattgctgcctgtcacacttggtgcttcaaaacccttggcaaaaggcaatttgaaatgtaagaaggctaaacttgaaccctgcaatctaagcagataaaaaaacaatgctctgtattttatagacctggtggagtagaaaattgaggctctttgaagaattaggttcccatttcagcagaaaccagactcatcgaccagactcatgtttagctcaaatattactttttaggccaatgaaaatggaaaataggttgtatagctcctacgagaagctaccttggttaccattatgaaaatattacataaaacaaagaaggctctcatttatctaacagtctacacagtgttttgtaagtagtcatcattctacccattctggcccaaattaacagtaacaaaagtggaaaaatcaagtgggaagcaaaagacttaatcacataggtaacctgaaaaaaacaaaagatgcactaatcaaaaactaagcttgtttaattcttgtttcaaaaatttgtgttattcaagtatttaaagccaagatgtctaaaataaaactaccatctctccctaactgaccttcatggccttccctctatgttccttatcttgataaatttcaccattatcattttggtggagtcacttcatctctttcctatctttcactcaatatcacaaattgtttttcaatatttccaattacgcacaattccaccatgtgtttcaaatttatcctctcccttccaccacgattgccatgttttgacttttgtcatctcttgtaggcagggcagtctagtggtaaagacactaagctttggtattatgccattgaaggtaaaatccctgctttgatgtgtcataattgttaggtgctgggtgagtgatttaatttctttgtttagttttctcttttcagtggaggttgtaattgtaccttcctcacagacttgcagtaaatattaagagtaattgttcaggcttaaaatagcattatgctcaagtgttagctattgatactgtcttgcacagacttttcaagcagtttccaactaattttcttgtcgtctttctctttctctctcaacaatttgtcttctgacttatttttggtgttattttaccactgagtttcagttggttcattgattcagaagccaatatcccactaagtttggttattagttttgacacctgtctgtctcttgtcttcaaatattgttcttgatcctttgctagtcttttctctaacttcaagttcacatcatcccttctaaaatttggcacatatctagctccctctactcttggctgaccagccatccccaagtgccagacaagatgaaaaatcactcctcaacttaaaaacctaacttaaaatccccattgcctctctgcagagtgaatgcagcatagtgcccaggaaagttttcaaaatctggccccagatcactttgctggctgcttctctttcatacttcttgcccctcctgactggctaagctttatcttttgaagtacctagaatgctcctcctttttttcccctctgatgaaatgatgattcttctccagagggccctgctgaaatattaactctttgtgaaatgcacctaggtgagattgaatttcaccagtatcactacagtagttgtgatcatcgtagtagcaggagaatgacagcaaaaacagccaacatttagtgaccatgtattagccagtaactgttctaaacactttacatgctcattaatcctttgagcaaacttacagattatttactatcatttctaccttatggatgaggaaattgaggcccagaagggataagtagcttaactaaagtttctataactagttagtcacagaatgaggatttgaaccaaataggctaatcccagagttatcacgttcaactttttaactctagtatctctctagttttgcctctcacagcattcacagcactttacttgtattcgttgtgtcttagatctacatatgtgtctgtttatttcagtacaatgttagtcttcagatgtagtgatctgagtgttcccctgtgcctggaactattgcttttcaaatagtgttccataaatgtctgccatattgaagtgaaattcattaaatttgtcaacagaaaacaggtgtcctgacactcctacctctagctttcctatactaaaacctgtgaatgatttaatgacaacttctggtagatatataatggaccaggaaaaaaaacccgcaattttccttttttcactaagtatcaatgtgactttgggcaagccacttcatctctttttttttttttttagtttggaagatagagattataacccttgtgatctgccattatcaaaggggttttatgaaaatgaaatattcaaaagaaagaattttaaaacttgtaaaagcccatacacgtgtaagaaacaaatattctaataggtaaaacatatagccaatatctgaacgatagggccaattggtattacagcagggttaaatggagtttctaatgtttcccatgttctgcctttcatggacagtgaagtaccacaaaaggaggaaatctgtgttagctttgaaacctccaccatttgtcacagccagaaataatgccgtctcaatggctgctgcaatgctagatctggaaagagacttgggcacagtctctacttcttattcgtggatggtgaaaggcccagagagaaggaaaaaaaaaaaactcattcaaggggctaccaccatcttcctgcacaatatgtgctgtgtatgacggtcccatgttgagcaggtaagtggaaaaagatctagtcatatttttttgtaaaactgaccagaacgttgaacgtaactagagaattggtaaagtacagagactttgcagctccactgctgtgttcaatctcttcccctactcccatgcctcttgctgatgatgtgattcagaaattaaataatccctcatacctcagtttcctattctgtaaaatgggtataatcctgtccaccttacagagttatttttaggatataatgagttatactgtgcaagccacttaaaactgtaccagacacatagtaagttctaaatgtttgttaaatagataaaaataacatctgagggtttgaacatgacacttttagggcttaaaatgaaattgaatgaatcttgctttctattaagaaatacgtaaatattaaatttacatttaacatgggttatgcctctgttcttccacagattttcctgactacatgcctaggtcagagcctttagctaaattcaccaaggagttagcatgagattaattaactgtcagaggttaaacattaaaaaaaaaatcctggaggttactgttgtatttttaatgggcaacatgttggccattcaagttgctttttgcaaacaaatcctccaacagccaaatgctgatggtttctctgccaacagagcatctaaaaatttctatgatcaatatgctaccgggaaaaacaaaacacactgaaatgttatggtatatttcatgccaaaaacctgaaacacagttaggaaattatgttttgcagttatgcaaggcaatgtactgatggtggtttattgatgagtggtctagtctcaccataaccttgtcatattcatgctcccatttctgctcaaataaaaaacaaaaacccctggaatgaagctctaatttagtgaatcaattattttgattgaatgagggcactgagatagtgctgggtagatgttgttatgagttaaatttagataaaaatgtgaacacatacaaatatacagataatcaagtgttgaatgttttatcttttgtattatttcctgaccattatctagtaagtgcctttttgtcaaataatgtccattgaatgagtaaggaaaatgactactttattctttggtaaaagaactggggcatagagagataaagtgagttactcagagttattcaataaggagttatagccagagacttgacagcatttattctttctttaaaaaagtgtttgtgcttacataaagtatagtagctaggaatttcttgacattaagtcatccataaagtagctaaatcccttaatcctgtaaatagctactcaatatcaatgtacattcacgagccagctgtcagcctccaagatgccacggaattgggaagaaatctttttttttttgttctgagatggagtctcactctgtcgccaggctgtagtgcagtggcacgatctcagctcactgcaacctccacctcctggagtggagttcaagtgattctcctgcctcagccttccaagtagctgggactacagacgtgccaccacgcccagctaattttttgtatttttagtagagacagggtttcaccatgttggccaggctggtctccatctcttaacctcgtgatccacccacctcggcctcccaaagtgctgggattacaggcgtgagccaccgcgcctggcccatgaagaaatcttataagaggagtgtgactctaagtctgactgactcttagtgtgactgactctaggaattgtcgctgatcctgtagatcacaacacctggctcctaagatctacagactctggaaaacatcttccatcatttagcctccttctttctaaatgctactatggttctggaaggctgacctttgtggacaatattatctggactccttgcccttctggtttcccattgggtttggccacgggtgaagaggaaaagggagaggttgtggtacttatcatctgggctcgctctttggtgagttgacaatagctgcatttcttatccaaggaccagagcccttttttattgttacagctatagctatggctttttccaccttctagtaaccatcaacctagaaatcgtaactttcgttcttgctaacactgaatgtttcatagccttattggctcaataaaccctgcgcatacctttgcaaattgtcccttcattcaactatcccctgttgccctatttaaatatgcctttttttccttcctggaccctgactgatactgaatcatagaatttcagtgttggaaagtactggatttggagttgagtttctgatttcagatttttttcagaagctctgtgattttgagcaaataatctcccttgtctagtcttcagtttcctcatatgtaaaatagcctatattccttatagtaggctattattattactactattgttataatatgctgtaaatcacttaaaatgtgatgactatttctttaaaaaccatgtagtccaactggctctcctgggtgccaaccgtatgaaattttcttttcctctccttgaatttttccagtaagttttcttctatgggtatgacagtctcaaatcttgcagtcagacagtaagcgtatctgtatcactggagtaaggttcttttgggtataagtttttgtttattcaacttctcagttgtgggattctgctcaaatcattataaccttttcaggccacagctacctcaattgtgaattgggtaaaacctatcctcctgcaggcaaagggccagagctaatgttttctctctctctttttttttttccaatttaaagatttacattaggaaaaacagctactactctagacctataagagctccctcaatcaatatcagaggtcatcagtggagctcagcctgctaaagtgatgaagacagcaggctatggagtcagaattctagctctgccaactggggcatttgttttgtttctatgtgcctcagtttttttagtcattctatgtacctacctcagaaggtggttgggaacatcaactgagttcatacttgtcattgattcatgctcatgatatttcctatactaaatactttgcatggattattcccatgacaatccattttctgataatcgtaatcttttttgtctccaataaaccatggccctttcctccttctaggacactctctccagaccttcacattactggctttccttttattttaaggacttaaaagacatcttgtcaatgaggctttctctgagccaatcaagatatgtcccctgcatatattccctttccatcatattaccacaggtttacttctgctataacacttatcacttcccagattacctttgttttcttgtttattctctctcttcctacataagctccaggaaggtagtaaactgtgttccactcttcactagaaagtgagtgtctagtatcatgcctgccctatatggtctctaaaaatattgtggaatgaatgaccaaataacgaaattaagaggtggagaatttatgtaaataagtttacagtaataaacaggcattttgtttagtatgaggcacaacaggaattcaaacacatgccaggatgatgctaaaacccacaatgcccctctttgcctctttcaatagttcttggaagagatcataaaagtctgagctggctcagagctgtagcaaaagagacaaaaaaaagtgaaattaaaagatattcagagagaacactgaccagagtttagtagccattaagatggtgggtgggggatcattaagcagagagaagattccgacttcagcaactggacagctcttgatgccaatgaatgatataagacgctcagagtgagtgctacagagtgatggtgattaggagactacatctggctgtgcattcatccgcatcctgggatggaggttcaaagagctgcgggcaattgactgcctaggggatcgtgggatgggccaaaaatgtgaacaagacaattctttgttcacagccaaggtactgctgactctatccctgtctcatttcttactctggttgaggcgatactagtgtcaggtggaagacattctaaggcctaaattaattctcattagatgatatctattactcttgctcaactaccaatcaggtagctcgatgggagaaggccattggctatggcatagatctgtcacctcctgtcttgaagccatgtgtgttgcttcctggtacatttccaagacaatggcgctttttgatatttgtctgatagtcttctcaaacatcaaagtcaagatatgtggtttatttaacacagtagtttgggacttagaagttttgcctttgacattttaaaaatgagaaatacatttaattttcaaacatttaagaatgtctatggttcttcatgcagaaaatctttgtcatatgctgcttcttttaatgctttcgtttgaggcacaaacaccagaactaatagtttaaatctgtatttaacaaatgactataaaaggtatataatttcgaagtattaagaatattatgcctaaataacaacagaactcaagaagaaatatgtatgctttgctgaaaaacatttgaaaggccaatttgtggaaaaattttctaatataaattgggaagcttgcattcagataaatcagttcttttatccaataattcaaaatttaggggaaagtaattttaaaagcatagatagatatatacacaaagccatttatcatggtgctatttatattgagagtgggaggtaaaaagaggaaaactctaaatatccaaaggcagagaatgggatcaaatacaatatactagagttatgcaatgtagtattatgcttgccattaaaaatgattttataaaaagttttaatagcagggctgatatttatgaaagtatatcatgtaaatgaaataataaaaatttggtattgatatgacataattagtacatatacattgatgggaaaaaagatattactagttatttgtagttacttcatggtagcagattatgtgtgtgtggcgtgcacgtgtgtgtgggctcttatctttctttgcactttccaaattgactgtcctgaacatgagagacttttgcaaacatgataaaccattcacctttccaaccctggaggagaaggcgaaaaaggaagaggagaaggcaggagtcttatggggtccacaaatcacgagctaagtctagcgtaggttcagtatcagccagtactatacaatcccattagtatttaaagtgattctgatcatttttttagtattttctattttttttcctctcaaaacatccttttccctcacagttagttgaaaattgcattgcatcctctgtgaacatttatttgggggcatggctttatcagacgctggtgcagaagagtgctaacgagacatgacaattttctacttctctacgtgaatacagagatccatttgaaagttacattttacctatctacagtgtacaaatgactatattttcagcaaatatctaataaattggcaattttgattccaacctgaaaggagaaaagcaatgactctaataaccaacaatctttgacaaatagtggcaataaaagtgcctgcagcttcaatatcatgtaggattagggctctggcatttttctagattatggtcttccaggttgctgatgatgttatgttttgtgagatggtgtgcatgtgtgtgcaatgaaagaaaaaaatcacagcaatgtatctaaactataattttaatttttgtatgtgcattggcttagtgctaacgaaagttatttagttctgcctcctctccccacagaatataatgtaagctctaatagaagagctttctttgttttgttttgttttggtttggtttttaatctgttttagtcactgctccatctcccagcacaagaagcaggcagtgacatacaataaatatttgttgaatgaataagcaaattaattaaatcttattatgatgatatatcacctttggtcagtgccattgaaacaaattgctattctattctgggacttttcactgaatgtattatgttgtttgtggttctttccatattttctcatttgtgttgtggagacccatgacattttagtgcattcatatttttaaatcactaattgaatccatgagttcctacaaaatggtgtagcagtataaaaagcgagtaggtggagctgtgggttatagccccaatactcagggaattccacctagatttttaatgttgcattttctcactagcaaataacaccaccttctctgtctgattctaagagttgtttgatgcttgaaaaaaattgtgtataaaagaaagtttgtacacagagaatatttgtcaatgtatattctaagttatatagcatctttataaaataagctgaggatttcctttagatattcctctattttctactctttaagaatgccacaaaatagagaaaaagaagatggagaatgtgatggttaacctcacttgtcaagttcggcaggctatagtacacagtgatttaatcaaaccctaatctaagtgttgctgtgaaggtattttgtcgatgtgcttaacatctataatcagttgacattaagttaagcatagattaccctgaataatgtgggtgggcctcatctaatcagttgaggcttcctgaagaagaaatcctgcctcaagactgtgacatcaaatccttcctgaacttccagctgccagcatattctatgaatttcagacatgccagtccccataatggtgtgagccaattccttcaaataagtctctttacatatatgcatatgtacatgtgtgtatatgcatgtgtatgtatgtatatgatatgtatatgcttatgtgtatgcacatgagtatgtattggttctgtttttctagagaatcttgactgatacagggaaagaatcaacaaagaagaaaagtcacgtttatttaaatgacactttgtaatcttttttctaatctagtgatatttctgaatttgggcagtgtccactgggattatagacccagtggatgagagtcaaacaatgtacaaggtcatatgttaaagtgtccagctgctctgctaacaaggcaagcaataggaattcctacagttacttgagtccagtccccatcccttacatcaaacaaaaatgtcccagtgttttgcaggacaggctcctgtcactaagactgtgctgtcagtctgcaaaatggaaaatgactcctaattgcccaaatgttctcctgggtatttaggtaaacatgagtacatcaatagattgcttttgtagaatatactgattctttgtagagaacggcaatgcatgcaggcctaaagaaacgaaacaagagtttcggaggaaaaaaaaaaacaaaaaaacaaacttgctttgaatagcaggagacgacgttttggcagctgagcagggcaagagcttcatgagccgctctttaatgctgcgcttggtgctgttctgagcgtacaggaaacctagaagatacaggatcagttctgttaatgctgtctgcagagagaaaagggacgtgctgcagggtttatcagagaagccaggcaggaaggatcagggacgcagccatccactcaggcaatcacaggcagtgggttgggacccccgaaaggaaaaaaaaagtttgttttcttcttatttagttttgtttttatttctaaatgttgttttgaagataatgacgaacaagtgaaagcagaatcgtaaaatatatctattgaacggcaaaagattaaaaaaagccaccaaaaaaatctggtggtttttttttttttttttttggcccttagatcagggataaaacaagtatcactagaagagttaactggattgaaatttcaatattcaaaccagcgctaagggcccacatgacaattttctgctattgctccccatctttgattatagcagagatagatgcttcacataaatcattcacaccacaatcacctgttagtacctttgccttcctgaaaatgagaaaataaatgtccttaatatgcagcttcattagcatatactgacatgcccagagatgtgacaatctttcccattttttacatgtggacgctaatgaatggaactttttcaaacagactaattctggaagaagccagacaagcttgtcaaacattaacccaggaatagacggagcagtatgtgtgacagcagatacctggagatgactcaagaaaaatcaaaagtggctggacgggtgagcttgcaaactgctgaaacaacttttgatgtcaggagccaactatccaagtcagcatcaatttacccaccctgaggtctcagacacttggatgtcatgttaataggtaactagcctccccgagatcagcatgcaaggtgtcaaatataaagcatcagcgcagaaaacaatttaaatcgaggttctaccatctttataacaggaatctggcaaatgtatcacttgttccttttctagttcttatcttggaattataaaaaaattcctgaccacaagcctactgatttagtttcctaaatcatatgttgcacccaccaacagtatccactggctaaaactcatgtgtgtgtgtagagtaggatgacaaaatgaagtagtaaatacacaaattaaataagatcattcctctgattaaaagccctctaaaagcttcatgttgtttttctatcgaggacgccaagtatgatctggccctgtctgagtctctggcagcatttgcagccactctctctgctttctgggccatccactattggccacactaccctttttgcctttggtagaactcacaaagcaggccgtcctctggccttgacacttatgtggtatgaaatgtctcattcaactgctggttgagggtctggcatgtaacagaaggtcaataaatgcctggcaaatgagtaaataaattcactttggatatctaaagaagacttgattcatttcctagattagtatctaagtaagctttttaaaaattttactttaagttctgggatacatgtgaagaacgtgcaggtttgttacataggtatacatgtgccctggtggtttcctgcacctatcagcccatcatctaggttttaagctccgcatgtatgtgtagagtggggtgacaaaatgttataaatgtccttaatatttccctccccttgacccccaccccctgacagacccccgtgtgtgatgttccccttcttttaaacttgcaaaataaatctggtttacataaaacacaccctatattttgcttctgatttccatttctggaaggatgcaacgatttaactaccctctcctttgcaaactcctccaggacatgagggtcttactttagctccctacacaggcactctgctcctcccctttatgccatttcaaacctccgtgccaggatatgtgctgttccctcagttttgtcagctgttcaccaactctcaacttctgtatcccagtgcagccttttttttttttttttttcaagacagagtctcactctgttgcccaggctggagtgcagtggcgcgatctcagttcactgcaacctccaggttcaagcaattctcttgcctcagcctcatgagtagctgggattacaggtgcatgccaccatgcctggctaatttttgtatttttagtagagacagggctttgccatcttggccaggctggtttcaaactcctgacctcaagtgatccacccaccttggcctgccaaagtgccaggattacagacgtgagctactgcgcccagccccatgaggcttttaaaactcagttcaaacacaccttcctctggccatctttccctcttgtgtctccaacttgcctaaaagaagaaagacctcctccctcccctgcttcccaagctaactttgggagaaatttagcttatagtttaaatgataatggcccttccccaaaactaaactgcctttgtaaagctaatgaaagatcaccaggttaggaggatgagaggagcgtgaattctgctaaggtgtagccataagctattaccagccgttattctcgaggtcatgagattcataacttccccaattactcctgcagataacatcactactgtagaacctaagattggctttttgagatgtcttttcaggtttttgcatttctgacaatgaatggcttcgcccagacctgccaaccagtcctgtgaccctacccagaagccaactcagcatgaggaccattttccatatccctaggattgcaccccaaccaatcagcagcaccctttccattacccatcaactatccttgaaaaaccctagcctctgaattttcaaggagtcttatttgaggaataataaaactccgggtctcttgctcagctagctctgtatgaattaagctctttattgcaatctctctgtcttgataaatcagctctatctgggcagcaggcaaaatgaacccattggacaggttacagtatctgcttcaaaaagttaggatcagaggaaataatatataaagcacttatcacagtgacagccacataatgcagtccaaacaaatattaatcattttgtttcacttatttgagtataccctattccctactgtctcagggccttttcacatgctattatctgaatctaaacttctgctttactttctcttcatctggttaatgcctgttcatccttcagatttcagttcaataactttttgaggaaaaccttatagggcaaaccaactagattatgaacagttattatagatgcccatagttttctatgtttctccatagcaagtataattaaaacaattcatgatacaattacatatttgacacgtcttccctactgaaatggaagatggaagatgtctacttctagcctttacagaataaatgttactggatatgctataccactgtaaggaaccatataactggacaagctacatgagggaactctttccaagaattgaacaataaacaacatagaactgtgatgcttgagagaagaaaaatcccagaggtgtgcttcacaaatgccctggctcgcccctgcctggtgacatgttccttccatagttcagggaggtagagctcatagtcactgagctgaagtggcagagattagagttccaggctcctgaagtggctggaatttgtaggccagggttaagagagaattgatgtatgcgtgtgtattctgcaggtagctggtgggtgggaaatttgtgtgaaattaaatgtgggttattgactaagggctgggatatgcacgatatccaaggcttcccaatgcttagcaggcagggctgagaatggaatgaaataacacaagccacatagagctggaatgctgcaagttgttagagttctagccctgccagccttccaaagaagacttcactgagcacctctggcgttgccctgagaactcagaaaaaccactttgggagtaaggataatttcctagagtaagggccatagtgtatcactgaggtaatagccaaagttgactgatcctaacaaagaatagacctaaagctagaaagaccaaaaagagctgctgaactgtagaatgcttcgaaacaatattcaatatattttaaaagaaggcaacatgacccaaactccttacaatgtatcctaataacatcttttgtactataaaaaaattactagacatgtgagaaagcagaacaaatgtgacccataatcaagaaaaaagagaagtcaataaaaacagacattaggtagcacagatgttggaagttgtaagaaatgacgttaaagatagtcataataagtaaagaaaaaagttcagaagagaaattaaactacaaaagggaactaaatgaaaattctagaaataaaaagaaaattctaaaaggaaaacttcattagatggacttaacagcagactgagaactactgaagaaaggattatgagcttgaatagagatgaaaaggaagaaatctgaataatagaaaaagatttaaaaataaagagagctttactcatctgtgcatcatatcaaaaagtccaacataggtataattaaagaacataatgagaggtgagataaaattttgaagcaataatgaccaaaatattccacatatgttttaaaacacaagtgaaatctgttgaaccaaaagaagaaaacttaaagtataataaataaataaataaataaataaaagaagaatcacacatagctgtaggcaaaatgctgaaaatcaaaaatgaaaaaaggctttaaaatgaaaagagaagaaaaggacccgtacatacaagggtcaaataatgtaagaataatttttcatcaagaacagcagaaacaccagaaaacaatggaagagaatccttaaagttctcaggggaatacagagactatcaacccagaattttacctatgtttttgagaatgaagttgaaataaagatacttttagataaaataaacctgggataattcatagctaaaagccttgcattccaagaaatgctaaaggaatgtcctcaggctgaggttaattggcataatacggaaacttgactctacaggtagaaatagagagcacaggaaattgaaaatatgtgaataaatatattatcctgttttcctttcctactttctttgtttaaaacagcaaaaaagtattgtagagtttattacatttgtagatgtaaaatttctgacaataataacatgaaagttgggggagggtcaatggaattttaatgtatgatgcttacattttacatgaagtggtaccatatgaactcaaaatagtctataataaatgaaggagacatactgaaatctctagatacaagggaagcagtaaaaaataatataagaaggtatagtcaaaactccaatagaggaattaaaatgaaatatataaaatatttaattaatttaaaagaaagccagggaagaggaatagagggacaaaaagtagaagggatgagtagaaaatacataagatagtaaatgtataccccaccatataattaaatcagaaattgtattttttattcattactgaattcccagtatgttgcacagtgcttagtatataaaatgttcaatcactatctactgaaagcatgaaatcagactatatatcttttatgattgtctcagtatgtgcagatttgctacttgtaattagcagatgcatttagaatgtacatatatgcttcctcacagtgtgtgaagcgatccctaaatagatagctgtgtgtgaaggcactctcttaaggatgatactgacagaatgaggaggtgggactgaattccccagccaatcacactaaaagaaagttgatggtgaatctccaaactgccttagtatgtaggacatttaccctcacagagactaaacactctttgttttcattaatttattaagttaatatgtatcgccacctacaatggacagattcatatcttaaattaattggctacataaaccactgagcctaatgagagcattcaaaattaagtcaaaataatcctagtttacctcaaaatccttgtctttctccaaattaagggcctggccagctgtcataaattacatattccttttggtttttttaaaggttacatgttcaagagagtgaaaataagatgttctgtctaaaggctaccatgcctggtttgtaaatgaacctgttaaatgctgtatttgctcccacagcttactacagaatgttacttaatacaatatcatacttattacaatttttactataggagtgtaacaggtaaaattaatctctattttagtgggcccatgtttagtctttcaccatcctttaaattgctgtgaatttttttgtcatgacttgaaagcaaggatagagaaacattttagagatatctgggtttttttccattccagaacttgtgaggataatcatatttgcttcatatttatagtcatgaactcctaagctggcagctacaaccaagaaccaaaaaatggtgcattctgcttcttgtaattcatctctgctagtaaattataagaagcagggaaaatattttatttggatggtttctataaacaagggactataattcttgtacattatttttcatccttgctatttctttgagcagtctaatgtgccacataattatctaaggtatttgttttctataagaattgtttcacaagtattcttgttatcagagtagttgtattatatttcaaaatgtaagatgatttttaaaagcctgagtactgacctaagatgcaactgtatgaactctactctggagggcggggagggtgtcagtggaagtcgtaagacttttatttttttgtgccatcaaatacaggtaaaaataattgtgcaattctgctttttaaataggaactattggcctgcttggccctaaatggaagggctgatattttaagttgattattttattgtaaattaatccaacctaattctttttaatttggttgaatgtttttcttgttaaatgatgtttaaaaaataaaaactggaagttcaaaaaaaaaaaaaaacaaaattaagtcaactcccatacctctgcatctagaagtcaaaccaaactgctagtatactaacataacactttaaagaccataaaacaaagcaatacaaaaagagatgaaaaattacttttcatctcataaatatttgtccaaaaagcattctttataatgtacatattataagcattataaatgatgttctttgtagaactgtaaatatacagtggctacatagaaaaaaaatccctgctgtctagaatctaaccatctgcatctattataatacctatgacattgcagatcccgaattccctgaggggaggattctgtttgtttatgaattaactcatttaaaagcatttgttgaatgctaactatgtgctaggaactgtctcagatgctggcaataatgcaccgaatgagccagccaaaaaacttctattttagtggaccttacacgatatttaggaaagaaaaaataatcaacaaaaataaatagcaagttataaagtatatcagatatgaaggagggatggggcctagagacttctgttggtggatatggatatgggtaagaaataggacggggaaagacataattttaaatatggtggccagggaaggtttcattagagatatatttgggcaaaaatatctacataagatgaaaaggtgtcttatcctgtttcgattattaacaataacagtgtattacatatattaggtactaatatatatttgttgagtgattcatatcacttattaatttattaagttaatgtttattgctacctacaatgggcagattaataaattagttggctacataaaccactgagctcaatgagatcattcaaaattaagtttactcccatatctctgcatctagatgtcaaaccaaactactagtatactagtacttcaaacacgataaaatgaagtaatacaaaaagataataaaaagtaagtgtgtaaatatataggccattctaactgtgctctaactaaatgagaatgtattcatttttaccaattggaaaggttttatcttataatgcctgacattactgaaaacacgtcagcctatcatcatcttgattgctccatttttctggtcatgcagacctcagtggtggcatatgcaagtggtcattctccactggctgctttttgtgttacacaggaaatgccatcacatgtcagtgtcatgtgtcagtgctgagcgatgggccatgaattatgaattcaacaagtactgacagtggcaatgaaagtggtaatttcaccataatgagaactattcttatcttcctcctttttgcagtacagcagatagcaaaaacttctatttctcatgggttagcttggaaataatggctcgtactctattaattcacagtcccgatcagcttctattttgtacttttgaaacacggacaatgtttttcttcctagattttaagcctgtagaagtctggtggaagaaaatggcaaataatgtttctacagatctggtgtcttcccatgaatcaataactatgacaaaaattgggctgagcaaggtggctcatgcctgtaatcctagcactttgggagtccgaggcgggctgatcacgaggttggtagatcgagaccatcctggccaacatggtgaaactccatctctactaaaaatacaaaaattagccaggtgtggtggcaggtgcctgtagtcccagctactcagcagactgaggcaggagaatcacttgaacccgggaggcagaggttgcagtgagccaagatcacgccacggcactctagcctggagacagagtgagactccgtctcaaaaaacaaaacaaaacaaaataaaaatcaccaggagtttcaggggtactgtgatcccatctgtgttctttgagtcagtgacaagctgattcatcagtagtgtcatggatgctgggaatagggagtacatttttttactagttgcaaatatgaacttatttattaggtttgggcaaaagtaattgtgatttttaccattgaaagtaatggcaaaaactgcaattacttttgccccaacctaatactatgatgcctatttttaaagtggacttacagttcataaatactagcatgactacacaaacaaacacatacactcagaattcatttagtattttcaaattcattcctgaagatactaggccccagataacttggggttcatatgctggtaataattcttgcagaaaattgctgcccaaccatgcagttgttattggatcttgcagtcagccccaaatcattcacttttaagagaagtagcaacagtgttgctgactgaatatgaggaaaatacctacatttcattttttaactttttgaacttgggaggcagaaaatgaccttcctaattgacctgttttgttatgcttgattataaaatagtttgtgtatcagtttaaaagaaggcaactagaaggtgcttgaatttgctgaaaacgatctacagattccaaatgcaaatggagtaaatttgactctacttagagtggctacctaaatacacctgtttctcataaaattaatgctactctctgtcagcctttccatctctctatctgtctttctgtctctgtctcactctttcttagtctttgtgcctttgcttttatctttgtctctttgtctccctcttcttctctgtctctgagtttctctggctcaatgtctctctctgtctcattgttctacatctctgtttgtgtctctcctttatctttttctgctctgtttctgtctctaccccgactcagtctctctctcaatcaaggcagggtcctatttaatcttctttaccttggtgttgactgtgttcttaacaaaacatttagagagagttttggtcagttgagtgcagaataattattgcatgttatctgaggcaaatattagcaaacaactggatggtcaaaagctgtaatgctttctaaagccgcttctaagtgtgtttgtttttatcacctctctgctgtactggcagaactagccagagaatactagcagaaaacaacatggaaaaggcatcaattttccttgggatcttttaagattgaccaattgaacctcaattttcccttgctcctctgaacaatttgccaaaactacttctacagggctatcctttgtgtggggtttggaaattatctggagttccttataaatagggtgacaagaccttcgtttgtccaggatgctgccagtttatgggagttgtcctaacaccccatagtctgcacccccttttcatgttcaaaaatgttcttgtttaaatggtaaattatatgttcatgcaatattagcaaccagtatggtctgttccacagactaaggtacagtcattgactaagtgaatacttcattgcactgtaaacaatgtaaataatgcaatttcattttaaaaaatggtgttttaagaatagctaaattaatagagaaggtgaaataggaaactaaaaatgtttttgtgagcacattaaagctaacatttatgatggaaagatttggaactttagggttcagggagaactcatttgaatctaagcgctgccactttttgtttgtaaggcttcggaaaagtaacaacatcactgagcctctgtttttttttgtttgttttgagacataatctcactctttcgcccaggctggagtgcagcagcttgatcatggctcactgcagcctcgaactcctgggctcaagtgatcctcccgcctcagcctcccaagtagctgggactatgggcacacaccaccatgccccagtattttttttttttttttgtagaaatggggtcttgcgatgttgcccaggttggtcttgaactcctgggctcaaacagtcctccccactcagcttcccaaagtgctgggattacatatgtgagccacctcacccagccaccttgcctctttgatctcacctgtatatgaggtaagcagccaaagcaaaaaggaatttatcaaaaatgacagcagtatctttttggatataacctaaacctaatgtactatttcttttccgcaagctaacacaaataactcttatttatttttatattttttaattgagtttttgatcagtgagccatgatcaagctccatgctggagtacagtggtgtgatctgggctcactgcaacctccacctcccaggttcaagcaattcaccttcctcagccaccggagtagctgggattacaggtgcctgccaccacacccgactaatttttgtatttttggtagagatgggatttcactatgttggccaggctggtcttaaactcctgacctcaagtgatccgcacacctcggcctcccaaagtgctgggattacaggcgtgagccaccgggttgaagcatttttaacaatcaagcattgtaacttcaaacttttctttgggataagccaagcatgcctttaatatcggaaagcaagcgacaggtgagtaaggttgattcttctgatggcgagagaacacaaataaattgattcttaataggatttgggattacaaggtgtattttcgtgttggagtgtccattatacaatgaatcttctcctccaatgtcacccacagtaactagtatatattcttaggtattgtctaggctactctgttcattttatgactggcccatcacctgaccactgccttttaataacatatttgaagggattttcaggaaaaacagtcacttgtttccttttgttcattctttttattttctcttagtataaaatcctgcagaatctcatagtctactctaagagctttggcttctactcagagtgaaataaggagaaaacggaggaggattttttagcagaggaatgatatcatcatataatgttttattcaacaacattaattaagcacctatttggcactggcaaaaacatagtccttgctcttgtgaaatgtataatctaatggggaaggattaacaatagaacaagaaatgaattaaacaatagaacaagaaagtcctctaaatttcatcttgaacatgatcttgttctaagaaaagatgcagacaaataatgcctaagatgcaatgctctaacaacaataagaacaaagagaaccttctatgtgctaagtaccttacaagcatcatattatttaaccttcacaagagccccacttgtggaagataacattatgaaagccaaattatagcagaggaaattgatggtaaagatgcacgcagtttgtaagtggcagtatcaggaatgtgaacacttgttcatctgtctagctcctgggtctgacattctgacttctgtactgcactaacaatggctccacaaaatggaacacttattggatgtgtctaattgtgtagtttctagctgcagaaaatttgtttctctttgtggtatggttttaatttccttctctgcctctttggttaagcttcttaacccatcttgtcttgaatatagtcctgagagcatggtgtctttcattcctttgctagaaatgctacctctaattctatttgcagtaggacatccatcaaattcctggtggtattaaaaaataataatgtggtttaggagaaagctgcactaggagatccaattttttcatctgaaaaatggggctaataatagatgacactaatctcaaggaagttgggagatgaatgaagtaattgtttctgcaaaatgcttcaaatgccagaagaaataacatataatccattataatttttgatgtgagacagtactttcctttcctgagttcttttgtgtcactgtatttaattttcatcttttaacaatgtatttatattcaataaaagtctttattcattaatttaaccaataagtatttattggatataaggtagaccctgtgccaggcacccgggaagaaaatcaaatagaatagtcaatgaagcaaagtctttacaatcttgtgaatatccattacttggccatgattgctcattagaatcaccaaggtggctttaaaaaattagccatgcctgatcattccagaccaactgcatcaggtaattctaatgggaggccaaacctgagaaccactgttctgctttgggaaaatatgatgccagataggttttcttaagaactgtagacttttgatattgcaagctgattcctggtgggctagagttggagctttttagctcaaacactttttttttaaattaactgggccaaaaactaaaaatacacatattccacttagaatgttggatttctggcttctgaggaggaactggatggtctggcaaccttttgtctgcatttctgtatagcagaaattggatgggtctggtgaggagctgcccctttcacacaggacatgcatgctcggtttgccagtttcctctgttgcctatcacacccaacgctaagagacaagtcaagtgctattcatcttggttcacttaactcatttacattagctgcctggcccctgtaggaatttaacttttttactctcctctggttgtttacacatggacattgtaactggtttgaattgtgtctttcaaaaattcatgttcatctagaacttcagaatgtggccttatttggaaaatagaatgtttgcaaatgcaattagttaatataaagttatattggtttagggtgggccctatagccaataactggtatctttctggaaggagaagacagacacacagagagggaagcaggccatgtgaggacagaggcaaagattgaagggaagccagctaagagccaagaaatgccaaggatttcccgtaatgaccaggagccaggagaggaacaagaataggttctccttcagagcctccagaaagagcctaccctgtggagaccttaatgaagacttctggcctcctaaactgtgagagaatatatttatcttgttttatgccatccagtttgtggaaatttgttacagcagctctagaaaagtaatacacacatcagttaacagattttcaaaaacaccagagaaaataaaattaagccatgtccatatattcatcccctactgtatatagaacaatgtctgcacacacagaatcgccaaaatgtaagacaaggggctctacttgtagtgccttctcattagtactggtattttttttttttaattactgccaagctcactcatcccaggcaaattagtccaccacacactaccatggagtggatttctacttgtgtgaaattggcatgttctagattctgtactgctagtattaggtaaatatcagttgaggctgagcattcacaaagaactaaactaaaagtaaatattgtccagtttttgtttcaattaattaattaatcacatgtttattgaataactgatgactttccatatcactaacagccaaattccctaattagcaacctgtggacaacccaccccctccaacccaccgcccctaaatctcatctgtctcctcttctattttcctctaatttctttccttgccactgctggtcactgtgcctgaaatgtctcctctcaaaaatcttcaagatctctcccttacctccttcaggtctttattcccttgccaccaactcagtgaggacttctctcacagggcacttaaaactgtgtcctcacgaaactacttcctattctctttcaattttaccccataggttggctaatgttatagcctaaattgtacctgcccctccctccccccgccacccacattcatagtgaagttccaactcccagtacttcagattatatttggagataatgtttttaaagaggtaattaagttaaaatgaggccattagagtggggccctgatccaatatgattggtgtccttaaaagagaaagatatactgtgatgtctaagcccagaggaaaggccaggtgaggacgctgtgagaggacagccatctgaaagccaaggagagaggcctcagaaggaaagacgcctgctggcagttctgtcaggagatctgatcttggatgtccagcctccagaactgtgaggccagtaatttctgttgcttaagccattcagtctttgacattttcttacggcagcctatgatggtgaactttgtatgtcaacttgacttagctaagggatacccagatacctggtcaaatattctttcttggtgggtctgtgtttccagaagatagtagcattcaaatcagtagactgagcaaagaagacccaccctcaccagtgtgggtggacatcatctagtcctttgaaggcagaataggaaggcataggagggtaagttccctctcttcctcagctggggcttccatcttctcctgcccttgggcatcctggttctcaggcctttggactccagaacttacatcagtgcccctttcagactccaacttgattatgccactgactttcctggttctccagcttgcaggtggcctctcatgggactttttggtcttcgtaatcatgtgagccaattcccataataaatcaacctctttctgtttctctctttgtatacatagtctattagttctgtttctttggagaaccttgggtagacaacatagccctagcaaactaacagagctaaccacatgacttattgtccaacctggaacaccactaacaatgaatgaaggggatattattaataatgatatccagacacttggcataaactgtaacttcccatgtatatcaggacatttggtagccttatccatagtacctatcattataaatgcacaatgcactttagttagttagatgtttattgcctgcctctctccaccagatagtaaattccttgagggcagaggtttttgtgcttttactgctttatatctagcacctaagtatctgggacatagtagagtctcaattgaagaaactgaataaataactgtaaactgtaaggatgtggttaatgttcactgatctatctatatttatgtctatatctatatcgtatctatctatctctatctcatctatctatctatgaaactttctcaatgcgactaccaattattttgtacctgctattggctaagcaaggtactaggcattttacatatgttatcactcattttaacaacaactttgcaagctgcttatggtttctattttaaacttgacccaaatacctcagagattttaggtaacttctcctataccgctcagcatatagctaaagattcaaacttattgcaaaaaagatttttgtacattcttggcagttaaacaataacataaatgcagatttctagcttatcaaatttaatgatcaatacttaggatattgttaactgtacatgttgatgtgccagtgttatctacaaattatatcaatgtgggttcagaataaattgtattttttaaaaaagtgtgggtagaaagatctctaatgctttaatcctaaatcctctatcagcataacagaaaaatcagggacaacaaatcaatgtccctaagatggatatgagtagctcttcctgctaatttgatttttagtaactaattatttaggctggcacacaatgtgaaatattgtccttgaaaacaggccctgctgctcaacattttatttattagaaactgagccaggaaaatctagtgttaaaatttatcatagcagctgaggggttatgtcctgatgaagtaaaataatgccatgacaagatgatagatgttttctgatatcttcttatcactatcttgaccagaccaaaatattgcctaagaggattcttttgagttatgcaaagtgaagtcacattttgtatgcaattttgaaataggaccctataaataatcaagtcttacactatttgcaacttgaaaataatgcaatacacaagtttttgttacatttgtcaagaatttcataacttcaaagctggctggctgaatgaatggtgagctctttaggatattgtgctaaggtaatatcccttaaagcttgcagataaactctggacatccttattagccttatggaaaaatccactaagaccttaaactacttgaggtctccaagaacatattcttcaaatagaacatgatccctgtgtaattcactctgactaggcttcatcctaaacacagtggaactaaatttttaatcctgaaaatgctagcatcactcaattccattctacaaatatctgttgatgcttaggacttattaagtctgccctgatactttccccaaggatctcagggttttattggagacagggtgaacttgttaggcataaaataatcttaaaaatgacctcactctgggggctaatcctgtgcctaagtctgtcattcagaatgtgctactgtattgaatctatcagattctccagctcttccagatctcaatgaaatggaatatagggctccttaggaaacccaagaccacctattttagaaatatgctataactaaacattgaaaaaggtacattataagtgctgtcatatgtaagctttaaaagaatcacttataaaggaagaaatgaaacccggggatgatcagaagtctgaaaactaacggagtgtgtacattaacctggtagattactaaggccaccccataaactatgtttcattcacctttgtgtccccagcatcacgcacaaggcctagcattgactgttcaatacatatctgtttaatgaatgcatcattgttggttgaatttcaaaggagaaagagaggcaggcttctcttcataaataaatcatgactttttcaagattcccaaaacaattagttttccactaaagcaatctgaagtgccagatcctggcaaacctttctgtccctgggagacaagcacgttcagaaaagcagaaccttcaaacttgcagagccagctcatacttggtggccttctcaccttaggctactagttactgagagttggggaaagtggggaaggagcccagcactgtcaacagactttattggttgaagaaaacagtgttgttaaaacactcacagatcataaaaagaaaaaaaaaacacccaaggatataaaattgagaaaagatatctggagaaagcaatattgtgttctcgagctaaaatttcataggaagcttttgaaaatgacctcctgggtaaggaaaattatggatcctatctattctctgattgagcaaacacattgaattcaatacaatctcagcaccacatgtgcacagaacagagcaggacaatttgtctgataaatgcgtttatagcaacaatatttatgagatctatgtaggctttgagacattgagctgaagaagtttgagcttcatgttaacaatgatagcaacacaagccattttgttttctttgtgagtgctttacaaagcactatccaatttaatcatgaaaagaaaacagtcctatgagataagcatgaaaaagtttaggaaacagaaaatgttaaagctcaatcgcgtttagttgaaactcctttcttcagttcttcccatactgggtttctctttttctttatgtccttgttatttaaaatgtaataaggacattggtacttattggtctcatcagcctcacccggtagcttgttagcaatgcagaatcttctaactcactcttgagctactgaatcagaatttgcatttaataagattctcaggtgatttgtatgcacattaaattgtgaaaagcattatctacatggtgtcatattagtcatctggaatgcctgcttttggaatcttaattcattatgaatgagggataagtagagggcactgttataagaatatggtgtcaatctatgaatcttctcaaaacataatcagattcaaatattaatggcattggtgatacataggttaaagttatagactctgaatcctggttttgccacttactgtgtggccttgggaacactccttaactctttaagcttcagttcctcatttataaatgagaataagtatactaaactcaagaggttattgtaaaggtcaaatgaaatgagtacccagagtggtcacacagtgagtttgcagtcatatttattctttaagtatgacatgaaacagagattcactccagctgtctatctttccaagaaaggaaaaaaaaaaacacaaccttttaaagtctttcttttagattttcactaagtcattcctttgaatactatcatagagacctgctttgtgttagctttgatctttggaattctgcggtggtacaaggtcatgatgagcttccagtgaattatcccacaaggaaaccttgacacattttctggacttttcaccacagagattactcatgtcttctcatattctgattctaagaggccaaaattattagataatggggtgacttgaactctaccttttttggatacaagtctggcccttctagggttgatacacttcaaaaattcttcttaaaatctgtggaacaactgaaaagaagctcagataaattctcttttccaggagtcttggagacaaggggacagaggaagagtgatctgtgcagggatgctggaaaccacagggagactacaggaattgaatcctagaaaaaggagctgattacaggagggtcagctgaaaacaaggagccacggcatacccagtttagttctctagcaccatcctggcagcaccataccagccagcaaggtattaggttggtgcaaaagtgattagtattgcaccagcctaatattttatttttgttgttattgctattttttgagatggagtttcactcttgttgcccaggctggagtgcaatggcataatcttggctcactgcaaccaccacctcccgggttcacgtgattctcttgccccagcctcccaagtagctggggttacaggtacctgccaccacaccgggctaatttgtgtatttttagtagagacggggtttcaccatgttggccaggctggtcttgaactcctgacctcagataatccaccctccttggcctcccaaagtgctgggattacaagcgtgaaccactgtgcccggctaagcctaatatcttaaagaaaataactaataaaaaattaaatgactgtgttctctctggtatgtgtagtggcaacgtgaagatccgacttttgttctgagtgaaacaagaaacatggaaaatgctttatgaaaacatattacatagagatgacttatttaatattgtgccattgtttctcatatgggaataatttcctatatatgtggtgtgcaatttaaaattagatatcataaaccactagggtaaaaatatatgaggcctataccgggatgctgtttcagcatgcagaatcattattctttatagagctaacaaattcttaaaagacaggctgagagttaaggatctgaaaacactgcaaactatcaaaggcatacgaggaatttaacaatgcaaaatgaaatttaagtgaagtaccttagttcctcttcttgctttcctactgaacagcaaccctatgtctttctgtagaaatgtttattttgcaccattattttgacacgttcaaatatgacactttggtcatatattactgcatatttaagcatgagacatcaatcagatacatgtaagaaatatgttggtttggtccagaaaggcaggacaactcaaagctggggcagggtagccactataagacttcaaaagaaccttggtctccacaatcttttatctgaacctaaacgtttcctttctattgatctcaggtctttagacaaacccaaccaattgccaatcaaaagatggttaaatttacctatagcctgaagcccccactttgagttgtcttgcctttctgaaccaaacgaatgtacttcttaagtgtatttgattgatgtctaatgcctctctaaaatgtataaaaccaagctgcgccccaatcaccttgggcacatgttctcaggatctcctgagggctgcgtcacgggccatggtcactcatatttggcttagaataaacctcttcaaatattttacagagttttgctcttttcatcggcagaaattaatgagaaactagcaatgcctttaattgcctgagctggttacttgagcagactgtcatccacgcctccctcctctgaagccctacttgctgccccactctattagattatcaattttagatcaactgctgcaggtggtgcctggctctacttgatgggctcccctcagtttgccaaagatttataaaagcagtgttttaaagaatggcgtttacccactgagctaattttcctctcagttagaattccatcattctttagccttaagagtaaaaagtgaaaggagaatggaattaactagagaactgcctatagttctctatgtgactgttgtgttacccttctctaatagaataactctctgctcttatggtcaagttggtgtcatccagagatgagatacaagaatccagggaaattttttatcaatgattgattttatggggcattgatttataatagtaacaataatttaaaactatatatatgtatgtgtgtgtgtgtatatatatatatatatacagatatatagatatatatttgaaaccctaggaaagttatatgggcataaaaatttcattttggaatcatttgtcaattttgccttgaagattcagaagccttctggaattttctgaacacaaataattaaacagtataatttccacactatctctctttttaaaaagatgggtgcttaaatatacagaaaacaactttattattgatttttaaatgtaatacaaaacacctaaccaatgcacagcattgaaacaattcatcaatttatctggcatccttgattggagagtccttaacaaaatgctaatttaattaagccttaactgtttttttctgacaccctgattagaaaatgttcaactaataatataatcttaaataccaataatgttttaaatttttacaaattcgtgcaagaactcttgattcaaatttgatttcctttctgtctaaaccaatctatgaggtaacaattttacttgtgtttatccttggtcatctgaggatgtagcagtaaagaaacagtagtcagaaggtgtttttaggagaaggaggaggaggaagaggatgaggcatgggagtaggaataggataaagactagagtagttttggaaaaaagcatttaagagagacagttttttcagcccagttccaagacattagatgatgttattagaacttaaaaggaaaaacgttctgcttgctgaaatgacattttgcatataggaagtgtgttacgttgctagggctgctctaataaaataccacagaccaggtggcttaaacaacagaaatttatctcacagttctggaggctggacatccaagatgtaggtgtcagcaggtttggttactttcaaggcctctctttttgtcttgtatcgatgagcaccttctcactgacctcacatgcccttttctctgtgctagtgtctccctggtgtctttttctctttttataaggaaaccagccatactgaattagggtttcaccctaatgaccttattttaactttaatgagtaaaatcacaacctcacagattggtttagactgaaagaaaatctaattcgaatcaagagttcccatgcatgaatttcataaaatttaaaatattattggtatttaatattacacaggtagttgaacgttttctttcttttttttttttttttgtttgagatggagtcttgctctgctgcccaggttggagtgcactggtgcaatctcggctcactgcaacctctacctcccagtgtcaagtgattctcctgcctcagcttcccgagtagctggaactacagacatgtgtcacaacgcctggctaagttttgaaattttttttttttaaagtagagatggggtttcactgtattggctgggctggtctcaaactcctgatgtcgtgatccgcccgccttggcctcccaaagagctgggattatagctgtgagccaccatccctggcctagtagttgaatattttctaatcaaggtatagggaaaaaaacagttaaagcttaattaaattcgcattttgttcaccacctctttaaaggcttcatcaccaaatatagtcgcattctgaggtactggggtttagaacttcaacatacaaattttgagggacacaattccaccactaacgggtcaatttccccttcttcttctttcctttccccttccccttccccttctcttcctccctccctccctcccttccctcctttcttcctttcttttctttctctctttttctctctttctcttcctctctttctctttctctctctcttgtcgggcagcctcccaacagggggattttaataaatgtctgctgactcttgatggggcaaatcactatcagctgtgcctattgggctgctttttaacattgctgctgagctgttggctagtgaaacatgttaaggttcttctggtcatccgaagatccatgtgccccctcccttatcagtcccttaccccgtctgcactgaattattacaatagtattataactggttatgcagattcatctatgtctcacccttccatgagagcagtctgtctaaagcctagttctaacgaaaaagcccacagtccttcactaattcaggcaacacgtttctgccatgtctgccttgccaggaactccactagacataagagatacaagagagagcagtcaaaactttcatttgctcccccttgccttccagataaagtccaaattcctttgtataacatttagtatttagaccttacccacctcctcaaatgtccctatcctggaattcacaaagggctatttttcacctcctaaacatattttgcacattagagccaatataccctttatgctctctacttttctatctgttccccttcctatagaaaacctacacatccttccattccagctttagacccttgccattgcatattgtagtgagacttcatggatgtatggaatgaagaaggataatttaaatgtttctgaactgagtatctgggaagaatgaggaaggaaccattcaatagagacagagaaaggtgaaagacaagtaggatttgtaaggtttggggcattgagttaagttttagaaactccatgagaacacattgttctgatgtgtttattgttgaatcttcagcatatagaacagtttctgccacacagtagacacacaatacatatttggcttaatgagagtatatgtgtgtagtccttggtaagaaaatgatgctacctcagtagtcatgacccctttatttcaaaagacacacaaatataacaaaattccagcaccacaaaaaataacttgacccttgaggtttatgataatggaaactgagctttaaatgttaacacaggttagaactgaggaaatttattacggtgttttggaaattaagaggatcctccataggtgtttttggggtcaactaatatatattaatgtaagagttttgtctagaaatttagaagctctaactctgctactgttaattgctagatttgcaactttggttcagttattaaagttatctgtttaaatttctataaaatgtagacagataatctacctatctcatgggattattataaaaaatcaaatgaaataataaatatcaaaacatattcaaaactaaaaatatcattgaggtattacatataaccacactggcaataacagacatagtttttttgagtaaactgctatggacaacttcaggtaggaaataaattgttaaaaagcacattcattgagaacttaggagagattggtagttggataatttcaagatatgactgattatttactttggttttttgatttttgtgctgttgttagaaatgtaaatttttttattttttttctttgagacggagtcttgctctgtcacccaggctggagtgcagtggcgcgatctcggctcactgcaagctccgcctcccgggttcacgccattctccttcctcagtcaccggagtagctgggactacaggcgcccgcatgatatcaaattttcttgaacaactgaactattattaatcgtcaagttttttttagctaattccttatggacatttaatcataacaacctattctgataaaagagattcctgatccagaatactgcacattattgtaatgtccctgtgtaccaacttgaggtattaatctaattaaccaaatttcatgtacctgtcctcctatctctattgcagagcctgtcatcattctttttttttttttttttttgagacagagtctcgctctgtggcccaggctagagtgcaatggcgccatctcggctcactgcaacttccgcctgctgggttcaagcgattctcctgcctcagcctcctgagtagctgcgattacaggtgcacaccgccatgcccagctaatttttgtattttcactagaggcagggcttcaacatgttggtcaggctggtctcgaactcctgacctcgtgatccgcctgcctcagcctcccaaagtgggattacaggcgtgaaccaccgcacccggcctcgtcagtctttttgaaagtctaatagcttaaatactaacgattgccattacacacatcttaaactattaactatgctgaaaattcatttggatttgtttctttatgtcttgaagccatcctgtaatacccacttattgtaaagctggttaaaattcctctaaaatagatggaataaaattcatattgagcaagctttaatatgccattttcaaaagagaacaggtcaggcattattttgcaacagagaccaggttctagtgacatctactcagtgatgtttcccctgatatccctgttactgtgcagagttgaccatagttgtaatagctgttatttgtagaactcgatatagagttgcatggcttgggcacactacttatgctgctaaggctcagtttcctcacagacagagcaaggataataatagtacttgtctcatttagttctttgagaggttaaatgacataattcatgaaaagtgctttatttactcagtgctcattgtttagtaaatagcttgtaaatattacttattgttattattgagcataacaactttaaccacagtaaactgtgacaattggcaaatggaaacaacctcatgtcctccaatagggattggtcaaattcattatggtaactttagatgatagaaggattatgcagccattacataatctgttacagaggaataaatatcgacctctgaatatgctctagatctgctaagctaaaaagtaggctacaaacggtttgcttattgaatagactagaaaatcatatatgaaattgttactggtggttgcctttggaatgcaggagtttttaatttttttgttattttactttcgtgtttttctgctttcttcactgttttccatagagtgttatttcatagagcatattagagtgggtgatgttatatgcaagaaatgtatggcccttgtcactcagtgcaccacgcttcccatcattagatatccagttaatgatgaaaatggctatgcatatctctcttgcccatgaccccagcatcttgagattttataacacacacaactgtcgactgcattgcttatgtaaggccacacagagaacagactatcatcccccaaagcacccagtgaatgcttccattagggagcttggagcccactatgagagaaacagtcatgctcacatgttccccttagtcatttctgctgtttgggacacattactttggacacattaagacctacctatcccaaccttatttttttatgcctgcctgcactataaagattgaaaaaagttaatactcacttccctgtcttctttctattcaggactggtgaggtgatacaatgagacacttaccaatgtctatttcattttttttcatggatgggtgaaggcttatgcttttgtgatgacagtcatgactagtacatccttctctcttacttgtctagagagtaggtgcaattgagccactgcatttatcttacagccttaagggaaaggccaaaagattcccacagctgccagcaccgatatcactgagccgctaaatcaatgtgaacaaaaacttcttatttctagtcttctcattaagtgaggaaaataaatttctataggtttaagcagccactgggcagtttttcgatcactgtaaccccaaaatattcttaatagatacatttttcttaataccactgggatccagacctgatgcgtatctttttcgaatgttttgctataataatgattttcttcattctaaattagcttggatttctcctactggctcacctcactttagagtagtaaatctagcactcaaaagacttattttttttttaaagagggaaggaatttttgtgtgtgattatttgtgtgtctgtatgtgtgtgtgtgtgtgtgtatctgttacttgaaggggaggaagcttttaataataatgtacacctttgtcaacagtacatggccaagtacaattacgccctctcaagcatcattacccaacagatctatcacactgtgcctagttcactttttcctttgtcttctgcctagcctccttcaacaccactccaggatgaggaaagtgaaacatggggctgaacatgacaagaatagtgatcataatctatgtttcaaagaagaaatgaagcagaacgagcctaacggaaatttcagagaaagcttttagttctttttccctttcgtaaattctaacatctccctggtccttttgtccaggagttcagtactttcacggcagcctctgattcactgaaatgtacaatgtcttaccaaggttatccatccccatgttaaactctgttccaacataattatctccaataaaacttccctcttcttagtgtttgtaaagcaatctgatggcattgcactgaagatatagttatgcttggttttgcctagatcctctagccccgttatgcccctttgagtgtgacacagctcctagaggcagtctttggacctggttattaacggaagcttttcctcctcctttaacataagaacttcattttttatccccacatattaaaaaaagggatatcttcacctttaataatctgggaaactcacattgaagatttttacccaaaaagagaaaaaatagactccagtggaatggatatttctaacataagagaaaccataatcagacagattatgagaaaagtgaaacaaatctagtttgttttagctgaattgtctgtttcttacagggctatcctttcttcttactaaacaaggaaataacttgcctgactctgacaattacaaattactcttgtttgtagaaatgaccttattttatatgaccaacattacaatgtagcaagatgaccattatgaatattattcaataagtgcccagtttactgtcgtgtaaactgtgtttgcttacagcatttacttcctccatagtgttcagttttcatggttcattatttaagaaccatgcttacaaattttatataacagaaggaaccctaataaagtgtgagtagaaatagattggctttactgtaccatgtctagtggcttgagatgggttaaattaattttcaaagattatatacaaaggagaaaagggtgggtaaatttctggtaatagtttttgcaactttaatattttctgatcccattattcattttaaaagatgagtgcagtaaggctaaattgcattgttctaccgtcttcctgacatcttgatgacctaggttggcagggattaactgggggtttactccccaggctattccttttcgctgttataaataagtcagtgtagaaatggccttcactcattggattcacactctattttaaacccagaaaatacattctaacattttttattccaagtaatttataaacaagtttacaagtccgtcaaacagatttttgaatgactctattatccctcaggttgcagaaaccagaaaacttggaatcattatagaggaatttttgccttcaaataattgtccatgtggataccacactgaaatttctgaagcaataatctgatcactttttaatccagctcacagtgcatcaatgcttcctcagtacaactatgcttagtgataaggtcctctctaatttcgccccttgtttactttgcaattctcattttttgccatatacttccccaaagtaaggccttcataatcttgcactagtatggttacaagaaggcaaattattttacatttctggggctctgactagaattactcctctgcttatccttcaggttaagttctattaacagatatgtttttaaaactcagatttatccagattaaaaaggaagaagcaaaattatctccatttgcaaatgacatgatcttgtatgtagaaaatcctgagagccacacacacaaaaaattagagataaaaaatgaattcagcaagttttaggatacaagatcaatatgcaaaaataaattcatttctatgtgcttgcaatgaataattcaaaaatgaaacctaaagaaattcatttataggctgggtgcagtggctcacacctgtaacataacaactaggttttttatatataacaactaaagcgtaagtaagcaagcaaccaaacaaacaaataaattgaacatcgaaaaaatttaaaacttctgtgcttcaaaggacactatcaagaaagtgaaaagacaacccacaggatgggagaatatttttgcaaatcatatgtctggtaggaatttagtatccaaaatacatagaaaactgttacatctcaacaataaaaagacaaacaacctaattttaaaaatagaaagaaatttgaataggtttatccaaagaagatatgcaaatgcccaataagcacctgtaaggatgctcaaaatcattagtcattaggaaaattgaaatcaaaatcacaagagaccattttatactcatgggtaaggctataataaaaaaggaggacaattatttgtgtgggtaaagatgtgaagatattagaactctcattactgctggtgagaatggaaaatggtgcggccttttttgaaaacattttggaagttactaaaaatgttaaacatagagttaccatatgaccctgacatttcaatcctaggtatatcctgaagaacagtgaaaatatatgttcccaccaaaacttgtacacaaatgttcacagcagcattattcacagtagccaaaaggtggaaacaaccacaatgtccattaactgataaatgaataaacaaaaggtggtttttttcagccaaaaaaagaatgaatagtgatatgtgctaccacagaggtggatcttaaaaacaatgtaccaaaaaaataaaaaataaaataaaataaaaaagaagtccgactcaaaatgccacacattttagaattccatttatatgaagtgtccaggttaggaaaatccataaagatagaaagctgatgaatgttagccaggaactgagagaaagagggaatagcaagtaactgctaatgggaatggggtttcttttggggtgataaaaatgttctagaattagctagtggtaatgattgcataaccttgtgaatatactaaaaaccactggattgtatattttaaaatagtaaaatttatgttatgtgaattatatctcaatttaaaaataaattcagcttatctattaggttctctaggcaaaacttccttacttctaaggctactcccagcactccttctccaattacactactgcagctcatagttctaggcgatttagtgtagtggttaagcagctggacagaatgaatgtctttcttaaaattcctctgtagctgaccaattgtgagcaaattatttaattgcactgggcctcaacttcctcatctgtaaatgggataataatatacctcactcatagggttgttttgaaaattatctgaatcagtattgcaaagcacttgaaacagtaccaggcatggccaggcgcggtggctcatgcctgtaatcccagcactttgggaggccaaggtgggcggatcacctgaggtcaggagttcaagaccagcctggctaccatggtgaaaccctgtttctactaaaaatacaaaaaattagccaggtgtggtggtgggtgcctgtaatcccagctactggggaggctgaggcaggagaatcgcttgaacccgggaggaggaggttgcagtcagccaagattgcaccattgcactccagcttgggcaataagagcgaaactctgtctcaaaaagaaaaaaaaaagaaaagaaacagtaccaggcattcaataagtacttaataaatgtgctattaccattaaagcaattgttttatctattattatgatcgctataaacattcccctaaaattcatatgttaaaaccctaaccccaaggtgatggtattaggaggtagggactttggtaggtgattaggtcatgaggatggagtcctcataaatgcaatgagtgctctcataaaagagaccccggagagctcccgcatcccttttgcatgtgaaaatgcatcaagaaaatggccctcaccagacaccaaatctaccagttccttaatttgggacttcccagctttcagaactgtgggaaataaatttctgttgtttataagccactcagtttatgatattttattatatagctgcccacactaaaataattataattattatttggtatgtctctccagcattgtaccctactgtctatcactataggcacttagagatgtgttgtttttgaatggctggtcccagggtctaattgaagtcactcgtgcctcttcaggctcagcaactcaactatagtctggtaatgatatctttggccaaacagtatagaaataaacaacatggtgggttcagatcttaccaacgatccgaaccctaattagttgaaaacataccaagaatgttgcaatctgcttcttctaaaatacatttgctccaatgaccacagaaagaaagaaacctgcctttgcactagggtctttggaaattaatagaaagttctgagagacagtagttctgtgaaaaggcttagattttttggatgcctgaaagaatgcttacacaaccttgcagtaagagagtctaagaagaaaaacaagttctatcattgcttgtgttccctatcctgaagttttctctctccaaatgactgttttactcatcagtttataatcttctagcatgacatatatttttcaaagcgccaacaaacgctatttattctctacatgaacatttctcttacgtactccaggaaataaaatattatactcaaatgagttcagcttcttgtcctatatgccagccctggcaactgagctgtaagcaatactttttgaagttcaccctcacatctactcagcaggagtgcaaagcaagatgagaaagtggctcattactttttttgagggaggatgagttccagcaaaaaaattaaaaccacaaaatattttccttgggtgacatatactcagactcagcaaaagtaactaaaagataattttttggatatgtgtagctttacaagcaatctattaaaatattttgattaatacaacatattaattttgttctgcaaaataaagaaaatgcctatagagtcaccaggtttttctataacaataatctactaatgttagcttcaagccactctaggacatactgaattttcttctttcttcaatcaagggtttgatgttgtctaatgtgaaacaaggaagaaaatacatacaccttatatgtatatatataggtatatatacacacataataaataaagcaatagtatttgatctactagtcagtgaagaaatgttttatgattatagatacaatatttggaatatttgacaacatcactctaattttatcttctttacacagaaaaatgataaagagctttccctcagtttaacattgcaagcaatcaatgagattaaatgttgctttaatgccagaaaacaaaaacaaacaaacaaaaaagaccttggggcacattggagttgaaaggtcttttcaaactgcattcttacactctcccatttttcattcttttcccatatggctggaaaaggggaataaattttatgatgccccaaaatgcatatttttgagtttattcctgaagcagacagcttcagagaaaaaaaaatgaattagttcaattttccatgttcctctacctcctacagtccttcaagttactttgtggtcataccacaatcagctctgtccaccttcactcacaatctcctctcttataaaatgacccctaactctctcaggttctctctatgatttctgccccaaagagctctcttctctgacctccacccacatttcctgcccacgtaacctcagagtggctttttagaagtgtttacctctttgcagttgttatggtgcacttgcctcatcctgtaaaattgtggtgatgtggcctatttttctcatgagattttcagtagctttatgcactaatagaaaatatatgtgtggtttctgtgtgcaatctaggagaaaaaatagtaccattatgaagtagaggagtgaaacagtgggaaggggaaatgaattttccacgaacacatgaggttcaagagattttagaagttcattttaattggtagcccttagcatccactcaaaaaatcagaaataataatacttataatcacagcacattctggatggatgtagcttctgttagctaaacagaaatctagtttaaaattgcaaaaatctttttccctcccccgggcagttttgctcacagaaagcttggctgttcagctatcaaagccatttgttttcagtcttaactcttttgcagcaacagttaagccaaacccataatggaggaacatttttctaataacctgtgatatgattagcttctccaaagtcctaaactaaactattttagcttaatcccagttaacttaattgtggtcacactcattttatttttccttacctcccctcctgtcctttccctttcatattttttccttttttggttcttccaccattgaccatcttatgtttatatatatatatatatatatatatatatatatatatatatatatatatatatatatatatatataaaattgagatggggtctcgctctgttgccaggctggagtgcggtggcacaatctcggctcactgcaacctctgactccctggttcaagctattctcctgcctcagcctcccaagtagctgggattacaggcacccaccaccacgcccagctaatttttgtatttttagtagaaaggaagtttccccatgttggtcaggatagtcctgaacttgttatccacctacctcggcctcccaaagtgctgggattacaggcatgaaccacccgccccggccatgatttatattttttgaatgactcttacttcaactcttttcccgacaggggtcacacatgtagttatttaaatttctctgttttatgaaatgtctgtcaagcacctccatgctaaactgcttcaccctaaaatgggatagcgagcaagaccagacgtggtcctgccctcaggaagcttatggcctagcaaaagtgggtacctcattcacattaatcattccataacctcaaatgagacaatgtcctgaacgaaaataaataagatttttgagaaaaaattttttttaaaatgtgccaggactgagacactgaaaaaaagattgaaagcacagtctaagctgacatctcagggctgagtaggttactcttgagaaacaaatctggccaggtgtggtggctcatgcctgtaatcccagcactttgggaggcagaggctgcaatgcctgtatcaggaggcagagataaagtgtgattcttctgtgaaagcctcttctagtcagctagcgaacacatttgagtaaaacccaataacgacaggtatgtggaagagatcgccatgttgcagaccttttgttttaacgtgtccaacttggccttcctcaggattggagctaattttcacatgacacagctctaaccttttgcaggtaagaccttttcatttgatttttcctcctttccaagaaaagttttgagcgttattaaaggccaaagtactgaaactcttctggtggaatttttcttctttgtgaattacttacagtgggacgaatgattcaaaaccaatacattgcagagttggacggaatgtgaaacaagctcatctctgctgtttcctccagacagggctactctgctaaaccgtcaagcagatgaggtgttaatcttacagagctttctctgtaaaatgttctagggcctcacaacctctccactgggaagctgttcaacatcttactcctgttttgcactctaggtccatattcctctttattttaagtatagatgaagaactcttcacatacttgataataattggtttctctgatattaaaagaagtcatgggtactagatacaggagcagatccaagtctagatggtgtggattaatgtcaaaccaggcatatcttttttctcttttaatacttttatgggcttttcattttatttcctctgagaagatgaagagtactccataatcacaggaactctccatggttctccttgctctctcaacacataattaagaaattcctactggattccagatgccgtactaggaactggaattcggcagtgaacaagacaaccatgtttcctatcttcctggagcctgcagcaagagtggtctcaccctgccctcttctcctttcctctcctccctgtgtaatacatcatgggtttagaaatggaggaggtggtctattacccaggaatgcactttacatcaaaatcagggcctgtataactgagtccagactcaatccaaatatccacaagggaagtctagagagttaggaaaaccaaatctgtgagcaaaaatgtcaatggcaagtaggccaactgtaagtaagatataatctgggcacaggtgttgcagactaaagctcccttttgctaaggtgctaacataccaaaggggcctttaggcaaggcatccaggtataaaggcccaatggtaagaataacctattttcttttcttgttttttacataaaatgatacagaaagttagagtgattaggattattagcagggctgatgtgagaggaaaagattataatagttataacagcaacaggtatatcatgttttacaacttgacatgccttattcagtgtgtttcagtgaaaaggggtcaggcagacctgagtttcaatctagtagacattagcccttggagagcagaggctctcatgttctcatttgcattccaggctcctattattgaaccaggagcactgaaaggtattccacgaatgtgtgtggatgatggatgagtccttgctcggctgcctttgggcagtttgttagtagaagagtcctttctctcttcttactctcattttttccacattaaaaaaaaaagatagatcgggcgcggtggctcatgcctgtaatcccagcacttcgggaggccgaggcgggcagatcccaaggtcaggatatcaagaccatcctggctaacatggtgaaaccccatctctactaaaaatacaaaaaattagctgggcgtggtggcgggcacctgtagtcccagcaactcaggaggctgaggcaggagaatggcgtgaacacgggaggcggagcttgccctgagcggagatggcaccactgcactccagcctgggcaacagagtgagactccgtctcaaaaaaaaaaaaaaaaaaaaagataaatatgtatgttttaatattgtttggcgggggggagtcaaatgagaaagcagctggtacatggaaggtgctcaataaatgtatttctttaaagctttattattatctctgaatccatttacttaccatcaaactttagtggaactggcctcagaaacccaatttctggctaacacataaccctacattggtaattagaatcctcttctctttctgggtcttgctttgaagtctgaagaggacctgctcgctacttattttgactatggtaatgtttattgaatggctctaggccatttgaaatgagacaagtataaaaaatttaaattacagtattattacaccattcttaagtaattaaattatttcagaatgtaattttcatatattgaaatttataatatcaaattatatgcaattagacgcaatttctaagagatatgagggagaaatctatttaaattttctattttgccaaagttactcagttttaaaaccattcatttcacgtgattctttaattcttgtaggctaaatgactcactgaacaattcctggacagccctgccgatatggactaggaaaaaattaattgtccttgtatatctgtgctaagattttgaaatgattaaaatttgtataataacattaataatcattgtaaagtacagtacttctcatcttgaaaggctttcatttccatctttatgcaacccagacacattatgaacattctgcaaggagaggataacagcacaggctcacaatcatgaaaaggaatattgtggaaccatatgaaatttaaggtaactggggcaaaagatacacagtggggagaggcagggttgcagactggacttttgtctagtcatgtttttatgagacatgcacagtacatggagaagccaagtgatccctgtggacgatggagagtgagtgagaatgacaatgatccacttgcattttaaaaaagataagcttggggccgggcacggtggctcacgcctgtaatcccagcactttgggaggccgaggcgggtggatcacaaggtcaggagttcgagaccagcctggccaatatgatgaaaccctgtctttactaaaaatacaaagtaagccaggtgtggtggtgcattcctgtaatctcagctactcgggaggctgaggcaggagaattgcttgaacccgggaggtggagtttgcagtgagccaagtcacgccactgcactcaagcctggccacagagtgagacttcatctcaaaaacaaaaataaaataaataaaaaagataagctttgccacaggatagaggaggaatttgagtcaaaaagaactggaaacaggaatactagagaaggggttgtttctacagtccagttaagaggtgatgaagaactaaacaagaaaatgtactggtgatgggaaaaatagtaagacacctgactcaagaggtgttcccgaggcaaaactgacaggattggagatagagaattctaagttgacgccaatgtttaaaagcttgtaatatagggctgatgaggatgcagtgagagcgtggaggatgagatgtaggttactttggccgccatttgcaatttttgaatcaaaagagatccaccatggattattgatgagaactgttaatatgtgtttaaaatttcacagtactttcagatatattttctggttagagccatacaataactctgtaaaataggtagatatgcagataagagaagtcaagtcagttgagtaaggtcacatgggattaattgtcagattatttgtttattatgtcatgttactttttattaaacaaaatcagtgaaataaagctataggtaggaataaagctatttcacatttgaacatttatgaaatatctgctgtggatgcttaatatccattatttaatttaaaaaatagaattgcagaatttaaattatggaaaactgtgattgcaaataaattcaatgctaatgaataatatccttttgtgtgtgtatggttctgcatagaacattttatccttttgaaataaaagcaataatgaataagctttgttgaattgctaaaaacaactattaataagtctatgtgggtgatgttaacaagttgaatattaatgaagactatctctattatatttgtcatgaggccattgtctttacagtatgctagatttatgacatccataactataatagttaaacttaagatgaaaacattttttatctcaattaaaaatatgcaaatacatacataattgctcaaactcatttcagatgatgtgagcaaaaataaatggcaaaagaagcatcagttaaataacagtagacttgaatgcaggagacccatattccaagcccagctttgtgactgttaccagttttaggaccttggttactgtgatggttaactttatatgtcaacttgactggcctaagagatgctcagatggctagtcaaatgttccttctgggtatatctgtgagggtgttaactggaagagattagtatttctatcagtagactgagtaaagaagatcaccctcactaatgtgagtgggcatcatccagtccattgagggcctcaatagaacaaaaaggtagaggaaaggcaaattatttctttctttggagctgtgatatccatcttctcctgctcccagacattgtagcgtctggttcgtgggccttcagactaggagtgattacactactggctatcctggtttgccagcttgcagatggcaaatggtgggacttctagacctcataatagtgtgactgtctgtctgtctgtctgtctgtctgtctgtctatctatctatctatctatctatctatctatctatctcctattggttctatttctctggagaaccctgactaatacagtaaataaatttacttcatgtctctgaacttcagtttctttatctgaaaaattagagcatgaaaataaataaagaaaagttcttagagactataatgtactcaagtataaaatatggaatagccaaccaagaaaactatttggaaatatttcttgcaagatgcctacagcctaagatgtagaattcttcaaatgcattaaatgcttttaaaaatattgtttatagaatttatttttcaagttatgttcttctggtgtacaaaatatcccctccactgtctctaaaaaccttataaaaatacagttttttacagtttatagttaaacatgtgagtacgtgtgtgtgtgtgcgtgtgtgtgagacaacagtgtaaaaaagatggatttttctctttggattatgaacttcctcagtagataatttcaaagggagtgatttgtcaaaagactccagcagtgtcaccaaaatcagaaaatagttctttaaggtcatcatattaaaggccaagaatcatttacatgtagaaatcctgctgagtttgctaaaagtttgtctttgtttcacagtcacaagttgtatttctattcttccattttcttgcaagagaaaacactttaagtcacacctggcactgagctaacaccataagcaggctagctacatgatgatatttgaaacaaatttaaaattcacttaatgaactcaattattgtgtcagcttataaattttcacaccattcctaacattttcttgtcatttttttctgtcttgagaatgaggtatctgcagtggatactgaatcatcaatatcttctgcatggaactgtatctagtttcttcattgtactcacctatatagatgcaacacagaaaaagctcattgatacatagttcataatttgtaatagtgactctaagatagctttagtgtgggacagtctcagaataatattttgaatgaagcaaaagattatatactagagaaccaccaatgtatgagttaggactggtttccacctttccatggactatggtgacttaagcaaacatgcacttatttctacaaaacaataagttcagaagtacgtggtccgatttaagccttcttgtttgtcatgttaaactgtgacttattttctcatgctcaaaaatggctactgtatctttaggggaagaaaagagaatggaaagaagcagtgtctgacccactccactttaacattgcattaaaattttttttttcaaagttcaatggactccagttacactctaatatattcagtatatgtgtggtggcttgtcatgtactcaattacatgtcatatacccaagatcaaagacttactccatattcttcattgtttagctcctatcccatacagagagtaccacatatgatttatttttttctcattttagatttgaagtcattctgactcagggatatattaaaatgactgatacatcctaattaattttgagtatgtgtggcttgaattattgggacattgaatgctaaccacttgataaacagtcttgaagcttttgcacttggagccaaattactttgatctgattgagagcatgaaacagtccatattaggttttattatttctaggccattgcttcagtgtgagaaatccacatatcattctcactaccagaagctccatgtatcagtaatgccaagaatggaaatcctctcaatggtggtaccaagcctaagcacgatctttgtgtcagatgaactttgagatgctcatgatttcttccaaataatagtgtacatgtttatgtagtcagagaatcctccagtttcattcccctttatatatttttaatagagtctatttcaatatattgcaatataaaagttttctcttttctttctttttaacctatatcctacaatctagcacaagcccggaacatagtcaaaaataaatgttgaatgaacgaatgactttgcgccagtttctaagcctctgtaaactataatgtcctcattagtaagcatatatgtcaaaatgcttagcaatctggggtaataaaatgcattaacttggaatcagtttgcgtcccagatccacaatttatcatcttttagaaacttcaaaattaacttttaaattaatacatgcattcattcattaatttaactccatcgactgctctaaacactggaaacacataagtggaaaaaatgttttctagtagctcatagttcagtgtaagagacagagaccagtgcatgataaatgctctatttctttaccttcaggtgggttagtaatgcctgcttcccagatttgtatggactcagtacacaggaatccatgcctactctgccttaaaatatgcaaaaaagcacttttgaaatgttaaaatgatttgctaaattattttaacaacttttttgaaatgtgaaaatggtctgaatcactattttctcataaaacagggctagtaccatgcttgttgcataagagagaggctaattcattatatgcaaaggttacctgtgttgggagtcccacatacccgctcggtgagggtatttggatgaggattcacaagtcatatccatgactattggctatttgaatcagagcaactccatcctaaataggaactgggtaaaaataaggctgaaacctactgggcttcattcccagatggttagggcatttgaagtcactagataagacaggaggtcagcacaagatacaggtcgtaaagaacttgctcatcaaacaggttgcagtaaagaagccagctaaaacctaccaaaaccaagatggcgatgagaatgaccaaatgccatgacgacatcaggaagttgccctatgttctaaaaacaagaagcatgaataatccacctcttgtttagcatataatcaagaaataaccataaaaatgggaaaccggcagccctcaggggctgctctgtctatagagtagcgattcttttatttctctactttcctagtgaacttgctttcacattactctatggacttgccctgaattctttcttgggcaacatccaagaaccctctcttggggtctggattgggacccctttcccgtagcactaggacttattacatgcctatgatttattacatggttacaatttattattacgtggcaggaggacacaaaacaaaatcagcaaaggaaaaaggcacatggggcgaagttcagaggaaacagttaagcacagacttccaataactctttccgagtggagtcacataggactcacttaattctaccagcaacaaattgttacaacaccttgaaatgttgttcctgataaaagctcattagagacaaagtgcccaaagttgtttttggggcctggtcacataggtgctctctgcccaagatttgagactccgagaaggaaatcaggtgttcagtatcaattatattttttatacaaacatattttttatacacagcaaattacccttatcagacagcaaataaagtgaatcctcctgaaatccaggttcccaaatgccagacaatggtcaaccttgcaagcagtcctatctgtttagctgtttcaggcctgctctgttaaggctcttctacacaacgcctaagggcatttgattgaaaaagacacctggcctcttggggtctttgcaatgcttgctaaaggaaagtttgacaggtgagaggtgcaggaatagaatgcaactttttatcccctccccttctctgggcaaaaacaggtgaaagattggacaatagattaactatgtcatctgcttgcccacctttctgattttgctgcttatcacagtattcatcagagatagaacagaggtgattttaaaactctagtacattgcaagacaccttcagctgcattcatgaagagtgctgtttatattgtgtttctgtgctttgcatgtactagagcttacaatttaaaatcaaccactgcagaactctttggtaaagtgagaaatccatttataaggttcatttcttaagtcattcatcctgtaagttcagaattgaatgttttgagattctttaaggcacacttgtggggcactggagctttttacagctgagtttccacatgagtcactccaacatactgaactgcctggacattactgaatttagaaaagcttctcttggatttcttgttactatatggtatttgtgctttcaacttagtttctcttgctcaaatatttagtttttgaacactggatataattgcacagccaaaaataaatttttacacctctctaaacaaagcaagaaactgtaaaatccacaattagtatcatgaaatcttattgtaattttctttctttctttctgttctttttttgagatggagtctcgagtctcgctctatcgcccaggctggagtgcaggtgtgatctcggctcactgcaacctccgcctcctgggttcaagtgattcttcctacttagcctccggagtagctgaaactacaggtccatgtcaccacacctggctaatttttgtatttttagtagagacagggttttaccatattggccaggctggtcttgaactcttgaactcgtgatctgcccaccttggcctcccaaagtcctgggattacaggcatgagccaccgtgccctgcccttattgtagttttctgaagatattcttgctggtgttattttaggaatgtggctaaatggcctttatctgagaaagtgagttattattttagggagtggcaaaagaaaaagaagtgtgtgggaataaaatgtttaaattgctgttttcttagcagctataatagtgcatgcagctgccaggactacaatatttagaaaattcaaggatatttatctctaccttaaaatattttgaagactatactcgcttacatttgcagttctttgaaatgtgataatggttgatcaaaagtaaaaagatattttcttgattcaacattaatcctttcctggagtaactttacccccaaaaaattaaaataaaaggcaaaaaatatttttttcttgctagaattttaaattctggagtaagatttgagactgaattctaactgttttcagtatgtggtacagtttaaattaaaatatgtgtcgggtttagtcataatgtccttataccatttatgttgtattcaactgaatagtaacactgtcatcataaatgctacatttatctagattttttaagtgtatttttagagccagacaacaatgcaacagcatctatcccactatttttgtctaagcactgctatattaaaaagcttattgtttctagggcttgttaatcttgaagacatgatttatttctatgggactaatttattcaattcgagcagggatgatagaaaatactagaataaaagcaaattactttatggatatgtgcctgtgtgtgtaattggacacaaagaacaattagaggcataaaaatgttcaaataaatgcattttttcagagtatgaaaaatatatggcatttttaatgtcacctataaaactacgtataatctataaattatattatccttattgggactattcattgatcatctaaacagaccaatacaaattttctaagatagtttctttttttttttgtattttattcttcctattctaccttgatttaccaagatatgaaactacaaatcaataacatggggaacttggaaaatccacaaatacatgaaaattaaaccacatgctcctgaatgaccaataaattaaagaaaaactcaaaagggaagttaaaaaatattttgaaacaaatgacaacacaacatatcaaaatctatgggatgcagcaaaaacagttctaggataaaggtttataacaataaatgcctacattaaaaaagaaggtagattccaaacaaatagcctaacattatgcctcaagaaactaaaaaaaagaagagcaaactaaacccaaagttagtggaaaaaagaaaataataaagactagaatgaaataaaagggagcagaaaaaccatttaaaaatagtaaaaccaagaattagttgtatggataggtaaacaaaattcacaaactcctaactacctaaggaaaaagactcaaataaataaaatcagaaataaaagtagaaatattgcaatggaaacttcagaagtaaaaatgattataacgggctattataaacaattatgtgcaatatttaatcaggaagaaatagaaagcttgaatggaccaataaaaattaagagattgaaatatgaattcaaaactttgcaacaaagaaaagcccaggacgagatggcttcatgaatgaattctactaaacattcaaagaagtattaccaatatttaaattctcccaacaaatagagatagaagaaatacctgcaaacacattttacaaggcaagcatcaccttgatccctaagccaatgacatcacaaaaaagaaaactataggccaatatctctgatgaacattgatggaaaaattctcaataaaatattagcaaacaaaattcaacatcacatcaaaaagattatacatcatgaccaataggatttatccctagcatgcaaggctggtttaacatacacgaatgaaacaatgtgacacatcacattaacaggatgaaagataaaaaacacagaattttctcaatcaacacagaaaaagcatttgacaaagttcagcatcctttcctgataaaaactcttaacagtttatgtatagaaagaaaatttctcaacataatataataaaggtgatttatgaaaaatccacagctaacataataatcagtgggaaacagttgaaagctttttcactaagatccagtgcaaagcacaaatgcccacttttgctacttctattccacataatattggaagtactagcaatagcaatcagaccagagaaagaaataaaaagcatttaagtcagaaagaagaaaaagtaaaattatctctatttgcagatgatataatcccttatgtagaaaaccctaaagattccacaaaaaactgacagaatgaattaattcagtaaacttgcaggatacaaaatcaacatacaaaaatcagtagcatttttatacactaataacaacatatctgaaaaagacgctttaaaatcccatttatgaaagcataaaaatagttagaaataaatttaaccataaaggtgaaatatttgtataccgataactataaacctttgataaaaaaagttgaagaagacacatataaatagaataatattctgtgttcatgaatcaaaaaatttaacaatgttaaaatgtctgtattaaccaaagcaatatacaaattcaatgcaatttctatcaaaatttcaaggatatgcatcacagaaatagaaaaaaaattcttgaaattcatatggaaccacagacacataaaaacagaataggcaaaggaacaatgagaaagcaaaacaaagcttgaggcatcacacttcctaagttaaaattatattgcaaagctacagtaatcaaaaacagtatacaaatggcatgaaaacgaaaatgtggaccaacggaacagaatatagagagccagaaacttaactaattttcaacaagggtaccaacaggacaccctgaagtaaagatagtttcttcaataaatgattctgggaaaattggattgcaacatgcagaagaatgaaattggaccctaatcttgcaccatatacaaaaatggactcaaaatagataggagacctaaatgtaagatgtgaaaccataaaactcctagagaagaacatagggggaaaaattccttgatattggccttggagatgatttttggatatcacaccaaaagcttaggctacagaatcgaaaataaataaatggaactacatcaaactacaaagtgtctgcacagtaaaggaatcaatcaaccaaataaaaaggcaacatacagactgggaaatatattttcacacagcatatctcctaagaggctaatattcaacatttgtaaagaacacttacaaatgagtaacagaaacaacaaacagcttgattaaaaacaggcaagggacctgaacatacttttctccaaaggagaaataatggctaacaggatatgaaaaggtatacaacattgctaatcattagggaaacacaaatgaaaaccactatgagatatcacccttcacccattaggatggctattataaaaaaaaaaaaagacaagaggttactgctggtgagagtgtggggaaaagggaaatacagtacactgttggcgggaatttagatttgtgtagtcattatggaaaacagtgtggaggttcctaaagaaattaaaaaatagaccagcaatgacccaacaataccttttttggggattgacccagcaattcctcttttgagtaggtaaccaaagatgataaaaatcatcaccttgtaaagatatctgcactcccatgctcattgcatctattcacaatagtcaacatatggaaacaacctaagagtcaggttgacagatgaatgtataaagacaatgtggtacacacacacacacacacacagacacacacacacacaaacatacactgaatattcttcagccataaaaaaaggtgatcctgccatttgccatgacatggaggcatgggtatacctgaaaaatattatgctaaatgaaataagccagatagtaagaaaaatagagtcatgtatcatttaacaacaaggatatgttccgaaaaacgcaacatcatttgctgattttgtcatcatgtgaacaacacagagtggacttacacaagccgaaatggtatatactactacacaactagtctatgtggtatagcctattgctcccaggacacaaacctgaacagtgtattactgtactgtactgaatactgcacacaattgtaacacaatgggaagtatttgtgcatgtaaacttatctaaaaatagaaaatgtatggtaaaaatgtggtattataatcttatgggactaccatcatatatgtagtttatcattgattgaaacatcattatggggctcatgactgtactacatgatttcacttaatgtagaatcttaaaaaagaaggtcaaatatgcagagatagacaataagtggttcccagggatggtgggtgggggaaaaaatgagatgaaggtcaaagtatatgaagtagcagatatataggatgaacaggtctagaggtctaatgtacaacagaagatgataatagtctataagagtctaatattgtagactataatagtctataacagtctaatattgtagactataatagtctataacagtctaatattgtagactataatagtctataacagtctaatattgtagactataatagtctataacagtctaatattgtagacaataatagtctataacagtctaatattgtagactataatagtctataacagtctaatattgtagactataatagtctataacagtctaatattgtagactataatagtctataacagtctaatattgtagactataatagtctataagagtctaatattgtagactataatagtctataagagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataatagtctaatattgtagactataatagtcttctgtattaggttaaggctttttgttaaataagtagattttaactgccttttccccaacccccacccaaagataactatgcgagatgatagatacgttaatttgattcaccatagtaaccattttactatctgtagtttttccataacttgtaaacctcagatatacacaaggaaatttatttttaaaaagtgtacttgtcaaaatatgcttaaatacagattcaactttcagtttttaaagattttaacataaataatttttaactattttgctataatatacattaatataaagaaacaaatgagaaaaaaattgtcaggccattatatagttcacttatatgacaaaatgaagggtttcctttcaaaattatgtgtttgcatcactggaatttagagaaatcctcatagcttaagtattggaactattgtttataaaaatgcagagtagaagaccaggcacagtggctcacacctgcaatcccagcactttgggaggctgaggtaggtggatcacctgaggtcaggagttcaagaccagcctggccaacatagagaaacctgtctccactaaaaatatgaaaattagcaaggcatgatggcaggtgactgtaatcctagctacttcgaggctgagacaggaaaatcacctaaacctggaaggcagaggttgcagtgagctgagatcatgccattgcactccagcctgggtgacagaatgagactctgtctcaaaagaaaaaaaatataaaaaaataaaaatacagagtataaacaagctaattgtaccagtgtttatgaaatgtctagtaaacatataagttgttaaataaaatttcctattttagtcatggatgcatacaagtaaatagatatttataacataatctgataagtaaatgttctaagttaatgagaatactgtggaaatccatagagtagcacctaaatctaccaatagaaggtgttaaatttatgaaggctttccaaaggggtaatacagaagttggactatcattacatggtttcacatatatcacactttaatttgtgattatccacaatttcttatattttaaaacaatttcaaagtaaaatctggcatactcagcattagtaaatgttcaaaatattagtccaaacaattgttactttaagctaaaattatatggatttgactcttcatttccttcttttgccataactttagataccacgtctagctgaaaaagaaaaaaaaaaaaagaaagaaatttagccagtactgaattgaaattacttcataatgttcacaagtagggtggctacccgttctggtttattcagggtctcttggcattttatcaaacttccatgtactggaaaaaccctaagttccagcaaaatggatggttggccattctacccattggctcttctcaatcaatgtgatatatttccacacttctatttgcatgtgtgcattgaagtgaaaaaaggttttggtaaagttatgtcacctcaaggatcagaagcaggtactttattcaagtaagtatgaaagcatgcacaaaaaagatatttcctatataaatagcaaaaattatagaaggcaaatctaggagtgatgctataattgatgtgaacttttaaagtgaaactgaagttcataaaataattttacttggatttcttgtcctccaacttcctcctgtccatgtttttctgcctcataaacacacgtacccacatattcagtcagctcctcctatattttatcaaaacaaaacaatatgttctttaacccaatgtcatgtagcatggtggccacctcacctatgaatttctctcttaaagtttaataagacattctatatctattatcaatttactagatcattccacatcatgtgccactggagactattcttccttgaatttctcccctctcttgatttattgacacaataccctcccagttttcctctttcaaatccttggcaactttttgcctatctgtttttgggcttcccttatttcactcacccttaaatttaaatatttatattcctgagagttttgtcattgatttgcttctctctttaatccacacactatgcaagcattgcagatacaacagtggatttttctaaaaagataaaaatttctatcatcatggagcttaagttctagtgaggagaaataaacaaaaaataagtaaaaaatataaacagtttatcatatggctctaagtgctatgtagaaaaataaagcaaggaaggaggctgtattatactcatagagctgccttgacaaatgaccattctcttggctatttaaaacaactgcaatttattctctcacagccctggaggctggaagtctgaaatcaaggtgtcagcagggacgtacttcctttaaaagctctaagggaaaattattctttgcctcttcatcttctagtgactccaggcatttcctgactttaagcaacatcactccagtctctgcctccatcttcacatggccttcattcctgtgtatgtccacctttccatgtctccatgtctccaaatgtcccttgaggacacagtcattggatttaaaacccaaccaaatccaatatgacttcatcttaacttgattgcacctaaagagactctatttccaaaaaaggtcatactcatagggtctggatgaacatacatttttgagatacactattccactaactagagagactgaaaaatgcttgttgcagtgattgatggggaagatgaggaagtcagtggggtatctctaaccaaatagctcataggcatttcaaactcaacatgtccaaaattgatgtcatcatgacagtctcttaaaaccagcttccaagcgcttgccaaatgctgttccttggctagaaacatggggataatcttagatactcaaactgtctccatttcccaacaaactcgaaaccctgtcaatcctacctcttagaaatgtatcaagatatctccatacctaattctactacctctctctaggccattcttatttctgtccaagttttccaccccaattctctacactgccttaaaggaaacttctaacaagaataatagtatcatgtcacctctttgtaaaatatcctataataactctccaatatttgatataaaatatggtttcccttacaagtaaacagaaattccacccagtttttcttagcagatgcaactaaagaagctctaatgactcaaaagtctttttctgtggcttccataaacatttttcatcctgtaccaaccaataatctcagttcttctcctactacatctatccaaacttcctcaaaccagctatactcaaccagcttctactttctagccagtttcagctgccatcatcatcactccctcctcttcatgagcatcaacaatgtatctgatagtgtttaggcactttgtgaatgtaatttttaattcacttaacaatcctaatgatagaggtcttgtgattcccaggttatacatgaaaaaactggaacacaagagcttaagtttctttcctgcaggattcttaatcatatgaaagatacagttttttttttaacttacaaattggagttaacagtatctactctattgaactgttattcaaaggattaatttaacaaggatcactacactttataatcttttcatagaagacaaagtggtggtgaaagcaaaggggctgtctgtcataaagttggtcctgagcctataacaggattaaagaactgcagtttccatcctggcagaccttcagcccttagactcagtggggactacctaacacaaccatagtatagaaaacgggttcatttattcatttagcaaacatttattccggatctttcatgtaccaggtactaagattaaaagatatgttttttttttctaaaataaggccccgtcctaaagatttcatcatgcatacaggtacattgctatattactctatttataaagcaataataactttactccttctacaagtactgaatatttactctgagtccagtaccctagtaggtattaaaaaaaattccaaaattctaatctaccagggagaggtttacaatgtccatactcagactgtacaatactctccatatcctatgagtcttcactcatcccttcattctcctgtattatttgcatatgtctgtatcctgagctcatccacaagcaacaggatggaaaaaagcgtgcttcttgtttatttttcaatccctcaccatgtcccacagagcacaaagtaaaatagaataaaatttagccaaaggctggtacctgaaaaatggctagcaataaaaccacagttattaaagacagagtgcaggttgcaaaatgaataatagttactctgcgcatctgccctgtggctactctgggccctcagaactgtctagggcatgatctcaagcaggtagatcagtgtgctgatctgttggctgaaggaaaaaagcgtaacgttcttggtgtccgttctactctccagtacaggtttggcattatgaaaggaaagaagaggggtagaagcctccttaggaaaaagagctggcttttggtgctgaaacacctgcctagagtgtttgaccactgctgtgacttgtagcaaaggtctttatttagtgctgcataatctcataaacacatacttagggcatgagcaaaaggtgcccccaaggagtcttttttttttttttttttttttttttttttgagacagagttttgctctgttgcccaggctggagtacagttgcacgatcttggctcactgcaagctccacctcccaggttcatgccattctcctgcctcagcctcccaaatagctgggactataggcgcccgtcaccatgcccggctagttttttgtatttttagtagagacggggtttcaccatgttagccaggatggtctcgatctcctgacctagtgatccacccgcctcggcctcctaaagggctgggattacaggcgtgagccaccgtgcctggcccccaaggagtcttttgaaagcttttgatatttgatactggaagaaaaaatgtgatcataggaaaatcagaaggtcatatgaaatttttgtctttatcattaaaactgtttctcatcacataagaagaaagcaccaaaacctcttcaagttttaagacttgaaaaagttttcacatggcccaactttaagtaaaaattagagtctgctttggatgaagctacctcttccacactcggtcagactcttccttatttacagcccagctataagtctgtccagggcatttcagaaataagtaattaggccataattatttatgcaaatttataaagcctagtcataggtttaactttctttcttcaattctcatgtttaactataatggttattttacagagaaataattctattttttcccttgaaagtactatacaatgactttagagattctagaataggtgactctatcttgtttagtcattatcaattttaaattacaaccaaagaaacagccaagcaaacatgaacagggtttctcataaatatacatctttaagtttcaaagagacagagctaatgaaactgtcactttgaatgctaaatggagctcttgatgtgcttacgttgaatcttctctagattttctcatacacgaaattttgctagtttttttttttttttcagcatcagttcaccactcaattaaaggttggtgcagaatcaggagaagccaaggcaaagaggagcccagaaaagctcttgtaaacacaagagcttttggtattggctgactcagagaccagctatatttcatgaagacaaaaccagtccagccagggtcctatgactgtgcttgtcacctcttaataacctgggtcaccactgatccattttaccagtctccatcactgctctgtgttgatgactagcatccttgatcagctgaagcatcaaaatgatcgggctttaagtcagaatatttaagagcaggtatttccagtcatgtctcttacgtgtactgttgttggtcattgagcataaaactggtccttcccactctttgattacataactgcctctaaactgcctagactgagcccctcacagcttcacaaacttctccaatgcctccctatcaaaccctttccattgacatttctgaggcctacattttatcataaaaatgaaaacaaagaaacaacacctcttacatattctccaattgtatagaacaatctttctattgcttatttttactgacacatggcttagtccagtcccaaataaaagacacacatgcctctgaagactcctgtcctgagagctatacttcaacctctttatcctgaacttcacatagaaatttttgaaatattattttatgcttacttctatttctcatttctcattcactatgcagccaactaaaaatgattttaccctttatcactctagcaaacagtctttgatacacatatctatgatcacctaattttcaaattcagtgactcatttttcacatttttttttattggactgttctgttgcattagacactgtggaaattctgaaatctctaagctttcctgatgttgctctaaatctctcaccattccttcctacccttcctcacctttaaatgtagatttgattcattatatcatccttgatctcactccataggtttcctggagctattgcttcccaactctacattcctatttgctatctccttgctgaaacttgctcatctcagcttgcttggctgattcttccagatttccgatgcttccctcattgctagatgttaaactttcagcccataatctttttattaatttattatttatttatttattttttgagatggagtctctatcgccaggctggagtgcagtggtgcaatcccagctcactgcaacctctgcctcccaggttcaagcgattctcctgcctcagtctcctgagtatctgggattacaggcatataccaccatacccagctaatttttgtatttttagtagagacagggtttcatcatgtaggccaggatggtctcgatttcttggcctcatgatccgcccgcctcagcctcctaaagtgctgggattacaggtatgagccaccacgcctggcctcagcccatgatcttttacactaaacagcacatacatctgtgcttcttatctgaattgactataccactttcttacccagtcacccacactggaagcatcttggaccatccgcaaccaggctttcaacaaatcaccaaatactgcaaattttagctttaaaatatgtatagaatctgatgttttccacttcatccaaagaccagtatcctggtccaagcttttagcaatgtctgaactcctgaaatagcacctaacttagttctcaaccttgagccttattcttctcatatgtaaactcctaagcaatgctctacgaagatacaaaaatgactacgtcattccactcctagacttatttcttacaactgcctgacttgtactttatgtagatctctcaatccatcaaccatttcgcaatgatgtgcctctggttttgtggtggtcttctccacctaggatgcctttctgttacttctacttgcaatcagctcttcttcatctgtccattaaggcacagcccagtcaacatttcttctaggaaggctccctgaccttcccttcttgcattagatgcaatttctcagtcgttctaaaatgagtaattattatagctgtcacttaactattttgtatttatttgatcttatgtctgtctcctcaacagcctttgagttcttcgaggaagatggctgtatctcatttatctaagtagtgtcagcatatgcaagttgctggacacaaaatagtcaataaaactcttaaattgacaacttaggaagtgatccaattttaattttctttcgttcatgaaaagtagggataaactgtgtttttcatgttcagagattgatgaaattcatgggatatttctgaagatctttaaacattcagcatataaaaattatgaaatacatttcttgtgtagtaatttcctataagggatattctgactgttggctctttcttcagaaactaaaatttcttagaaaataacttatttggattatcatctaattcagactttctttcaagcagaaattttatccaggctacaactattgatccagataattattcttatcattacttcttgtatcagtctttgaactacctttgtccatgttgttctgcttctagcaaagactaattaattagtagaggagaacatgaacatcagctgaaccgctgctgtaagaaggtagagaaagactgtggagaaaatatgggctcagagatagacacactggattccagtctcaaccatttaatgcctgagtgacaatgagcacatttctcagccactcttggcccatttcatgtttttcaaaatgtgaataacagtgttactcggtataattattttgagacgacatgagttaatgcttttaaaatacctggcacaataatttgaattcccctttccccatgagagttgacatgcacctactggataggaaagcctaaaagaactaaacacatgtttcagtatttaactatttgcatgctctctaatttctattcacatgtataatgacaacaggtcttctcaaaagatgatttctcagtaaaataaaattaaggcaagaatgacatgaaataatttttccaacgttagtagtgaacttatttctgctttacttgactggttgccaaagtttttccttgactatatgaaagaaattgggtaaacttttcttaattggcaaaacaaatccactccgaagtaaaagttacgaaacagatgttttctgcttcttaatagaaaagctagtacagaaaggaagttccaaatggaacattctggtggtgccaaaggaacggagaaagaaggacaaaagaagaacttttaaaggtagaaattctcattatgatgattgattatttaaacaaggttaatttttcgaggcttatgaacctggtaaatttaagacggcaaacaacaaaatgctactgctaattagacatccaatgaaatgccatacagaaaggttaactattttaaaaaatgttatgtaatcttctatttcaaatgtcattgttattagttttgtaatagagctcactgacaaaacagacatgaatatatcttccagagagtgaggaggaaatattttattagttgtccagtatatagagaaatgagaaaaatattacaataaattttcatccttcatttgaaatattcacatttaatcatttctgtaggaccggagttattttgctttgggcagacctgaccctaggcagatttgaaaacaacaccacaatatatgcattgagggcctactatgtgctaagcactgaggaaataacagtgaacaaaacaggttaaggtttctggccccacggagggattctagtaggggaggacttgaaatagggaaattgtagtgtaatgtgatgtccagtagtaacaaacactaggaagaaagaccgtttagagattgttattttcctgaccacccagcatagcaataatggaaacgtttggctggggttccctcaatgcattccctggccactgctgcaatgagtgagagattaagtgagtgtgaggagaagaattacatggtgagcactggataatttccccatcttaaccaacctgtaaggcagcctgaaccatctccatcctccagataaaacagctaggatttaggaaactgaaggaactcagcccaggtctctcagctagtaaactgttaatgcagtttctctgacccaaagtctgtgcaaatagaacatctccaaggatgcagaggcagtgaatcacagaagtagctgcattgcttctcctttaaggtgtgaataataagcaccaggtggtttgtgcgtattatcttctttggtccccaccacacaactatgacgtagggccattattatccacagtgctcagataaggaaactgacactgagggagggttaaataatttgttcaaagtgatggtaggtctataatacaaactaatctctgctatttccttcttttatttttatttttatttttatttttgagacagagttttgctcttgttgcccaggctggagtccaatggcacgatcttggctcactgcaacctccgcctcccgggttcaagcaattctcctgcctcagcctcctgagtagctgggattacaggcgcacaccaccatgcccagctaatttttgtatttttagtagagacggggtttcaccatgttggccaggctggtctcaaactcctgacctcaggtgatccacctgcctcggcctctcaaagtgctgggattacaggtgtgagccaccgtgcccagcctctgctatttcattctaaggagcttatgtacttttccttgaggttgttgacttcaaccatgaatcaagatcaatatgtttgattaagaatgcattgatcaaaataaggaaatcccagagtacagctgcagaatgtataaatgcaggcattgcatttttttattcaacctataattatttatgttgacatttattactacatatctttaaaaatataaccaactgaatttggtgaggaattcagtgatgctataatggtctctgttcttctgaagatgtgtggctgccaggatagtggtttgtggagcatcagctacaaatgctcttagaaagcagcagtgtgcatgccaaccagtttatagcctataagactgtattctcttcttatgaaggttgagcatctattaatagctgaagctaccatttgtggcagaggcaatattttaatgcttaagagctgggtttcaaatccttgctctgcaatttactacaaattacttgctgcccactgaagctttttgttaaatgctcattatattgctgaatgcttattatgggccagggactattctgtgcactttaaatttaatcctcctaataatcccaggatggatggctaaccccattttatggaggaggaaactgagctcagagaggaaaaatgaatcatgaatggctgtacaattaataaactgccaagctggttttgaaccccaggtgtctctaatagtttcctccactacatgacactgcaggaccaatgagaaacagtattgagactatataagaaacagagtcagctttgtaatcagggctaagcatttagatcccatactagctcaacaaggcactgtttctccagttctgtcaaattattgacaattttgatttgtagtccaatctagaataaaatgtgcaagggacatattattgagagcacaaggaagactatgaatgtcagagagaagaatggaaaggttgattctgagagtctaaaatagggaatgggttagctaggttaatcaaggtaatcacaggaggccttgaccagttgctctacctaaaactcagtttccttcagcttctgtaaagtagaaataatcatacctagttcattgggtgattatgatcaaaagtgtgaaaataagaccagcccctagctccattcctgtgcatgcacacattgaccatagatagccctcaactcaaccccacgttgatcatgctccatttttctcagctgcagtgcccctgaaagggaatctctggccaccatgagtgatctggaggagcagtttcatgtctatgctgagggtgatttccatccatgacatggtcatgagaaggacaacagagacaccttgaaagggactggagttgcatttccatagaccaaagactaatgagccactatccctttcactcaaggtgactactgagcaatcagctatgattacacacccctccatgactgaggattctgatcctaacaaggcataatggaaaattcacttgtgcttcacttcacacatgatgaaaaactaaaatacaatgattggttttctctttgtcagccagatgggttcttcctaaatgcaaatccacagaggctgccccactgtgatgaggctctgcactcatcatggcagagacaaagaaggtttgcgggtttgcctggcagcttgcccgaggctttgcatcggctttgggaaaaccagaggcctatctaagcctcaggctatccatctgctgccaggtagccctccctctgccttcatcctaaataaatctgttttggaggagccaggaagctttggggacaagatctattcactaactcatatgtaaaaatgccacctacatctggcaaattcaaatttctgttttctgagcacgtgtttatacttatttattgcctctcttaggtacagttagatctccatgaaccagttcaatcagacttaataacttccccaatgatcctagccaaaataagaatgtacctgggaagagaatcttagcctcagaactgcagttcagaagagcagctcttcttgaattctaccacatgcctttgaatctcaggagatctgggccatcaaaagtccatttggttccaatgtctcactctccagagtgtggttgatgaaccagcagcttggacatcctttgggagctgtgactaattcttaaaaatgcagaatagcaggtcctacccagacctactgattcagggcagcaatctaacaagaatccaggtgacttgtgaacacactgaagtttgcaaagtactggtttggaggtcattcaaccatcttattttccagagagggacactgccaagtgactttccagaacatcccacagcagggtccatttagaattccaggactcgaattcagttgtgttggcaagaacatttagccctatcttgaaatcttctgggcctttgtttccgtaacactaaaatggggacattcacaactgccttgcttccttgttggtatacaatgtcataatatatatgaaagcattttatttcaaagccttatgcaaacaaatatgtctactgttatatccaaccaaactcacttgaatcttaaaagatgtgtacgtgtgtgagtgtgtgtgtgagcaggagttctaggtatagaactgggccatatatgacaaattttgccctactttagaatgtaacctaattctcagactgcttgccaaaaaaaaagaatcctttctcctctaactctcaaaacggttcttaaaatagatgggccccccagggactccccgacatgtttccactgttagagttcaggcagcctgagatcaacgggttttatttcagatgatgttcgatttggggacatgagctcaggaggacacgtaacaggttagaggtgagcagccctttgtatttttaactttaaatcatggcagtcgctcaaatcaactatagtttagtagacaaagggaatgagaaagataaatataaggactgagagaagagaaagaggataaacgtaaggagaaggctgctgttgatagtatccactcattaaaaaaatactgagaagtttatatatgtcagacactgctctaagtattttggacacggtcatgaacaagaccagcaagggtcctcactgtgtatggcttatgttctggtggtggtgggtaggaggacaaattgaaaagcaaacatatgtccaggaaaacttggggtaggaaaacatgctttgagaaacctagctactgcacaggttctgcctatggttggatagccagagtgactactctgagatggaaattcaaatgaaaccttaaggagaagaagccatgtgtagataagggggaagagcttcccaggcaatgtgaatgctccgaggtgagaatgagctggggagtttcgagaaacagagagaaggcctgagtggtcagatggtggtgagcaaatgcagaagacgagttagcaaggttgagctaggttggatcatgcagggcctgtgtgtacacttaggaatgcggacacctgtctgagtgcagtggaacgtcattgctagctcaactagtgatccactgagatgtagaaattggaatcttggaatctcagcacgcagcacaggttaatagactgaaagcaggaaaatggaagtgtattttctcattcttctttctgtccttgatcttttcctcccttcaggtttttatcaaattcttattatgtgtcaggcaccgtgtcttagtgagcaatggactaaccttcttatgaagttaaaatacattcattggtgtgagttagtacaggatacctattccaatctaataaaatgcaggcccctaatgaaatggggtcctaatctgtgggcccccattgccaacagcagtggctcttaattgcagattgttacagtgaagaccttgttgcatgcaaaaatactaggattccattcagatgtattgaataagaatctttgaggatgagcctgcctatatgtatttttagtatactgcataagtgatgctgccagctgtgaacgtcctcttcttgagcctctctctggcatacctggcataccttctttgctcccctaagctccccttagtcttgagggatcagtgcaaagtctgtttcctctgttatcatcactctaacttacgtgactttgcctgatattcctagtttttgatgttttttagttttagttttagttttgagatggattctcactctgctgtccagggtggagtgcagtggtgccatctcggctcaccacaacctccgcctcccagcttcaagtgatcctcccacctcagccttctgagtagctgggattacagacatgcaccaacactctcggctaatttttgtacttttagtagagatagggtttcaccatgttgcccaggctggtctcaaactcctgccctcatgtggtccacctgcctcggcctcccaaagtgctgggattacaggcatgagccaccacacctggctgatattcctagttgttaagccctcaccaatcactcgttctcagctagaggtaagctccttgaggacttgagctgattccttttcatttcatcctcctagtacttagcctactttacatgaatttttaatatgcaaatgattattgccgctgattaaaataacctaaatacagagaagcctgaaagtgtaaggaagctccttaactttattttggttccttctgagataaggagaatgaatcataacaacaacaacaacagtcaacactgacgttgaaattgttaatatgtactgaacacttaccacatgcacatactgggctaactacacacggcagctcctaatctgttattcctcatttacatccctacatgcagttccctgcatgtgaccctaagaggaccagcttggtgggaaatgttctcagtaaacttggatcccagttccaactcatcactgattaatggtatggtccctttcaatctctctgagcctcagtttacacatgtggaaaatgagatggtaaactcttgccttttctcttttccagggttgccatggaaagccaacgaggggatacagtcagtgctgtgaaaacacatgttaaatgaagaagaagaaagataactcctgcttctgaggcaacaccagaattccagaagcagcagaccattgacttttctgctccagatttggaccttattcatttgcaatatttccaagttgctggttaaatctgaacttatctaagaaacaggtagtaagtgaaagagaatgtgagtcaatataatattggatgcctgaaaagtgcagcaaagcaaaatttaataagtattgacccaaatctttcatttctagttcaatttgacaataacctttatttttcaattaattcagccagagtttccctgagtcaaataccaggctggactttgcaggacctagagctcagccattgcctctgctcctatctttccagccagctttgagggggctcttatccgggagaggagagatattacccaccacatgtggttggagggagcatcttcgttacactcctgcagcatgctggctgccagcaaatggcctcacattctgtgggaaacaggctttctgcctggtgcagctttgcttaagcacaccgttcaggacgtggcctgggagtctcccaaggaatgggccagtatcatttgaatggagtcaataaaacctgttagtcaccttatcaacaatatcagaatcactgttgttcaaaaactgtattattggagatgactccctttgttttgttttctcctattattaaaaaaatgataatggtcctatccccaagaatggtaatatataacatattaatatcatgttatatgttattaccatataccatgtataccaatgtttaccaattggttcctttttctcacaagaaggaacttatgggcctttacagaatacatttcaagccatgtgtaagaacctttcactgcaccatttaatggaatccctgccaccccttttgtatggctggaactgaaagtcaaggatagggagtaactccctataggtcacaccattggcaagtggccgtgattttttgagcacatgatttcatataaatgtggcctttctcctgctattcctcacagctcttctgaataagtgagagtacggtaacagcgactgctcgcatgagagggagaggctgagatttaggccactttgaaaaaaatcctttgcaaatactgacgcatagtcacaatgttttctgtagcatcttgaaactcttgaataaaatgtattatgcttgtgctagtttaaaaaatagtaccagtacccctacatattactctaacagattctttgcagcagagctgatgatagggttatcccttcagactttctgcctacaagctacattaattggatgatgcaaagattggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttatcgcggcactattcacaatagcaaagacttggaaccaacccaaatgtccaacaatgatagactggattaagaaaatgtggcacatatacagcatggaatactatgcagccataaaaaatgatgagttcatgtcctttgtagggacatagatgaaattggaaataaccattctcagtaaactatcgcaataacaaaaaaccaaacaccgcatatcctcacacataggtgggaattgaacaatgagaatacatggacacaggaaggggaacgtcacactctggggacggttggggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataaataaataaataaataaaaaagaaaatgaaaaggaaaggaaatcatgaaaaactatacaattttacaaagcaatcatgaatatcacaaaatccagagaaataaaaatattttttaaattaaaaaaaaaaaaaagaaaatactggttcttcctgtgcagagaaaggagaatacatgccttccttaccaggaagatctacagctattagctagcatggaaaggagaatacatgtcttccttaccaggaagatctagctgtagctagcatggctcactattatcttagctcattagtctttttaaccttttgcctttgcccttgactttgagtcatgatgttgagtagaaagtgaaaaacttgccgaggggttcatttgattccgttgttgtggatatttcattctgtccacttttcctgggcagaatgaataagcctgagttgcttttaatccctgttgctgttctttgatattgaaaaacattctactcacagtcgatctgcaatcaaaatccccaagccactgagaagagatctaaccagatttctggtggcaatttaactccaagttgatgcaatcagtactctgcacaggcaagtgtgatgccattaaaggcttttccccctttgtaggttcacaaacttagcttttgcaagcagtagagaggcatgcaatgtagaagccaatgagattatagcctctgaatcagatttcatacttattaatgcaatcatagccttttgctccaggacttttacaaaaccaacttgacttcttcaaaccaatttgatgctgaaatggtcaaaaagaaaagtaacattaaatgcagggtgcactctctgctgtttttgcttacctttttttcttcccccattctccattttaaaatacgctctttcacagaataccactctaaagttacgtgggcatttgctttcccccaaaattcatatattgaagccctagcccccagtgtggctgtatttgaagatggagtctctaagaaagtaattaaggttaaataaggtcataaggttgggacactgatctaataggattagtatctttataagaagacacgtcagagtgctctctctctctctgtctctctctctctccctacgccctgccccacctatacatgcatagaagggagatcatgtgaggacacagtgggaaggcagccatcagccatccaggaagagagccctcaccacaaaccaaccatgctggtaccccctggtctgacttgcaggctccagaactgtgaaaaataagttgtttaagccacctattctgtcatattttacagaagcccaagttgactaacacactgttaatccaggaaattctaaatattttaagaaatttggtagaagtattagatgaattattcaaaagtccttggaaatgggattaaatgataaaataatactaacgagaaaaagtttgatcctctagaaatgattaagtaaaagatattttttaagtcttaaatgagaaccagcagcttctggtcatgtagtttccttcttaataaaagactaaatgctattccccctccccacacactcccatgtgcacactcatatatcttttttgaataggtgccatctaagtctgtttaaaggtagaaatgtttctgtacaattgagacctaactaacaatatattctaagtgtttgagtgttggatctggactactctgttttactgagttaatgaatttacttttcttatggaagaaagcaagaaaatgagggaagaaaaatctgggtttacttaagtagttgaagatagcacaatagattttcaaaatgaccagtcaaaaaccatgtattctaaagggcccaggatggctggcttcctttcttttcttttctttgtttcttgttttagatataaagtaaatttgttaaaaggcaaagttggcctttctccaacaacaataataatatacgctttgcttactgctacacctcttccaataacatggtgcctagcacagagtgggtacgcagtaaatataagtgaaatatttataagcgatatatagatgaaaaaatattatcaaggaaaaatccagctggattacaaatacatttaacaggaaaaattaaaaagtgacttctgcttttattattgatctacaataaaacttgcagtacaagagattgatataatattaaatatttcaaccataatctatatcaaggtatttttttttctcaaaatgatggtgactcacaaaagaagaaagtaaagaaacagattatatctaggcacttctatgtatttaaatattcaaagaacaaagggcatttaattttatccagatttagaatgacatgttcattatctcaaaactcctttatataacagcaattctgcattcaattatcacaatgtatgtactaaagttattaccatacttattctttccctctgaaatacaaaattttactatctagtaattgataccttgacaagatgtaaattttgctgaaacaaaactatatgttcaaagtcataagaaaccatgtaaggttgagaaatattaagagactgattgctcattataaatgatttatattaatagaaagcataacttttcccatcacctgactttataccacttttgaataactggtcataataatttcatgccagatttaaaaaattaattattaatttaatatgacagcattctttggatgtgaggactctgaaattgtctaacttattgtcttggtttgtttaggctgctataataaaatatttttttgaataagtaatttataaacaacagaatttattgctcatagctctggaggctgggaagtctaagatcaagtgctgggagattctgtgtctggtaaggacctgttgctcatagatgacaccgtcttgctgtgtcttcccatggtggagtggctgaataaactcccccagtcctcttttaataagggcactaatcccatttatgggaatggagccctcatgacttagtcacttcccaaagcccttacctcttaataccatcattttgagaattaaagtttgaaaatatgaattttggagggacacaaacatccagatcatagcacttgctaaggtttcataatgagtctgcatttgaatctttgtctgtttgactcaactgtctttccttgcagtcaagtgtgagttacctgttcctcctctattatccactctaacggcttctgtgtctctcttcagggaacctcagagtggcttcgtcactgattgcacatttacctttttgtagtatctgtctgtttgacttcataatgactaaaagcaacttgagacttctatatggttggaacctagcacagtgcataatattcaataaatggaccgggtgcagtggctcacacatgtaatcccagcactttggtataagcctccaaagtgaggtgggcagatcacttgagctcaggagtttgagactagcctgggtaacatggtgaaatccgatctgtactaaatatacaaaaattagcctggcatgatggtggacatctgtggtcccggctacttgagaggctgaggcaggaggattggttgagcccgggaggcagaagttgcagggagctgagatcgcactccatcttgggtgacagagagagactccgtctcaaaaataaataaatattcaataaatacactgtaatttactgaatgaatgaatgaatgctgttagtaagggccatctctgcattttgcagataaacatgctcattctcaccttatcaatattcccccaaactcaagaactcttctccatgaagagctatcaaaggagagtcattatcaaaaatggaccagccctgattcttcttcttctcctagaaatgtaatttagcctttgccctactgagagtgggccatgcaggttagcaagtagagtcacgggaaacacttccctgtgtttttctcaagaaacaggtatcctttctgtgcaggattttttttataaaggcatcgtgcaagaatcacaaattaacatccctatttccaagctatgggcatatgcattccatgtgatgtatgtctctgagcaaagttatcttcaagaataagtattacctcaagtgaacacaagagctcatgatcaaaaatgatggcaagaaacctggagaagctcaaagtaataaacagagttcacaatccaaaagcaagcacaccttctaaggtgttcaaaatcaacttcttagtattctgtacgaaagaaacatgttattttcatagaggagagttggaaagatttcttaaaatcctgggtctcactcagcctgagaccatgaaatcaatgtggttttgtgcaaagtgaacattacattagtgtttgttgatggaataattgaaattttaaagtcaaatcaatagacacttatttaaggaatatcaagtactctgcagggtgtagagatgattaaaatcacaaataatttatagttcaccttagtcaagaaggtataatcatcatgataatgtaaataaatcgatcaaggtataatgaaacaacaacaagagtgccacaagacattacaaaataatctgccaagcgggtcaggcagcaactgattatagaatacatgaggcattcatacaactctgatagcttcatgcccatacttctggcagatgtcactaattagtcacagggctttatccttctgggcccaggcgcatcctcaaaatctttctcaattttgtgagtttggcagccaattagctacagctggctggcaagataaagtctatttgtcatccctgccttatgctattcctcacatgccatggtttgggtcgtgtaatcctattatgtgccaccctcttcgatttctgggaaatgatctgaattgactcatctttttcaacctccgtcttcagggtcatcctttattgcagagactggaaagtgaaacactactttcaatccctttgcaggtagtattctggatttcagctccacttgaatttggcatggaggggagagaggcaggcccagggtagaggaagcatagttctgtgattgtaactcctggggatggagggttctcgtattgcagtggcagcttccttgagcatggcagaggtctggtggctgggggttgttactagaagcctcacctgcagcctattcattcagcccttctgactagcttctatgccacttaaactgtggtaatacaaccctttcttaaacacggcaaaatgtgtctactgtctgtaactaagtcctaataaatgtagcgcttttccctcaaacagctattaatatgaagtcttcccagaacagagtacagtgggtctctactttcctcttatctagaaactaggtatctgtgaacagacactgataccctgttaagtattggaagcctccaatcatcaattctgcaactaacagtctgcccttgtgtggttccctcatgccctctgagtctcaggttcttcatctgtcaaatgaagggattggttctgattgatggtggggccacttctatcttgagcactctttcaacttgataaaatgattttccagcaagtcccattcaatccaaaatactgaaaaatctacttatcttctaagaaactttcttgaatagagtgaaaaaaaaaattgagtagacatagttgattacctgagagaggtaagttgaagctatttctgagatacaaaccttacagtttaaaaaaactttaggtattccaatttcatttcatagatctggaaactggacaaattatatgcctaaattcacacatctatgggatggcattcagttcttttagttccatattaagtaatatcctccttttattattttaattttacttcagagcaaatgggaaggttatagtgcttattattggaatggaataaagaaggtaaatggcaatttacattatttctcagcaatgctcattagttatgtgaccagcccttgtgccaagccttcttgtgtattcttgacacttactgaccttctaacgcctatcacttcacacctatgtgtgattttctaaatttgattagaccttttttgacagggatctatctttcactcttaggaatcctctatgtgccttacattatatgggcattcaataaatgtttaccagtattcaattgaattacccttaggagaaaataaactttcacctctgtaagaaatcagatgtataaaaatgcataatgttttttaaacgttttctcttgggaggctgaggtgggtggatcacgaggtcaggagattgagacaatcctggctaacacactgaaaccccatctctactaaaaatacaaaaaaattagccgggcgtggtggcgggtgcccgtggtcccagctacttgggaggctgaggcaggagaatggcataaacccgggaggtggagcttgcagtgagccgagattgtgccactgaactccagcctgggcgacagtgcaagacttccttccaaaaaaaaaaagttttctcttactttattattattgcatagttatggctttattcatttcttgccactttatttaaggtgatgttcaaaaatgtactcactgcagaagaataaaacaatagattaaaaatgagagaggaatctaagcaagaaaataaaagcaagttaaagaaatgtattctaaatctttttatgattaataaatatggtttttaaatttgactttaagcatcctaacagccaaggcaagaagtaaaacaacctcttacaaaaaaccaatggccgctatttacaaatttatgagatgctggacaggatagcttttaatagaactgaatagaataatatggtgaaaagaacatgtatcagaagttagaataacacaaataactgctagcatttgcatagcatctattatatcaaaacatttttatataaagttcacttagcctcacaattctgatgtatatagtttgattagtagtgttacaatttttaaagaaagaaagaacattaaagagaaggaagacaaggaaaaagaaagaatagaaaaagaaaaagtggaagaaaagaaagtaaaaagaaaagaataaagggagaaaagaaaaacagacttactggggctaaataactcactcagcaaaacagatgcattaagtaaaagaccaagaacgggtacctcggttttctttcttcagattccacattcttccttcagattccacagtgaccctcttgagagtgagggttctatctagttcttgtcactgacaccactgttgatttataatcatattaatatagcttattgaattgttacaattagcaatgtgtgcttgaatcagacacactatactcattatctctggtcttaacttcataatgtatgatcccattttatagttctggaaactaaggttcagagaggttgagtaaagggtccaagacatacagcttgttaagtagctgatcaggaatttaagcctaagatcttatatctagtatatggcagagagatattatttcattccaggtttgcttggcttcaaagcctatgtcctgctgctaatctgtagccttctcaccaaccaaccatatgacttggaacgagctgtttacgctcattcatttcagtgcccatgaccttcagatatgggataacgagctgtgctttatctgccatgaatgcggtcaaataaggagaggcatatggaagccattttggatactattatagttattttaagtacactaatcacactgtatattaagaacattaatacttgtaatttaatcaccaaactgataaaatatagaattatctaaaaataatggtataatttgcatatgttataggagatatctttggctcttctcatggtattctctgctttctggcctcacatcccttcagaggtgcaggcttgatacagcaaaagacagaaggcaggtgtttggcctggagccctcttaagagatacttgtgaaatgagtcttaactccatcttctgagaaaatgattcaaatcatcgagccaggcaaggattacatttgtaaattttgttaaccttgatatgaattgctactacctgggtctcttgtttccttagtaaccttcctcaataagcattcataggaaagtttcttataggaagtgttatagaaaggactcctgtgaaattcaccagactgaggagattgacttttatggctcagaggatgcagtaggcaaagttcctaatggccagtgaagttcctctttcagagaacacaaatccaaagtgaattctgcaaaatctaccactgtacttattccttcattgagaaaatggggtgctttatggataaatgcatggaaaagtcagacttcgaccaaagtcaaagggcaatagaaaccctttgcattctttctaatgacttcaacctgtggagtttggaaagttacagattcctctggagggtaacatatgtacaggcttttttccctatttctttataataaaaattgatgaagaggaatacgtaaagtgtggtttccctttaggcagagttcagtggaagtagcattatacatagaagaactttcagctaaacttagagagaaacagagacttttaggccaatcattttcctaaatgtcactgattttgtgggagtaagtaatagcatctttcctaggcgtttgttacagaaccacgtaaagagctctactatttgggagatatgcaaacctctaaaataatctaagctaattagaaaatatctgtagctgacaagaagctttgtatctctgacatcaaacagtgcctggaagaggtgtgttggttttcaccagcatgaataccagcagtggcagacaccttcttaccaagagagtaaactgatggacatacacagcctatgaaaaaattgacattgctgagacagcgctggggattaacctttacagctgtgagatgtcaagcaaaattgaaatccaaccattgtggagcatgttgaaatcagtgggtgtatacaaatctctaaattattactttggccagatggaaaaggttccatttactgcctgctggaggaggtttagtcggtaacactgaagagggaaggaagattgaaaatgaggtatttttcatgtgcactaaggctgctatccaagagtagcataagagaggatagtcacaggccaaatgggtgacatggttcacctcttggccccctactacaggtagccaaaataaatgactgtactttgaaataattgcctttagcagcacgtgtttactgtcttctgttattacaattgctaccctataatgtacttagacagcatttaacttgctatggtttcagacagtgacacaggtttaaggcttggctccaaaatgctgaaattgtacacaagtttaaggcttggccccaaaatgctaaaattgtatctgcaagaaagggtatggatgagaattgttgaaagctagtatatgctaattcacagaggagactgattattaaaattctctctccttctatcctaggtatttttcttctttttctacttggaaaactgttaatcatccctaaaatctcatgacacactcactctctctctgatgcattccccagctccagtaaacagttagttgctctatcttttgttttaattacaccactatcatcgcattttatgaggtttctgtttgtgtatctctcttcccaccttgaacccttcaacacagaaaccttatctttaacggagttcaatgtggttgttaataatgagctctgcaaggagaccatgtatgctcaaaccctgatttcacagctgtgtaaccttgggtgcaatccttaacataatctgtaagatgaggaaaatgggaatatccacttctttgaattattgtaaggattaaacaagataataaaatacaaagtgctttgaaaagcaccaagcaccaggctcagttaagtgtttgccattatttcatttttaatatcaccattgtctggcttaatatcaggcatagagtagacagactgtgcataaaaaaataagaaaagttccataacaaataaatacgtcaacagtgtttattttttgcatatttcttccttagttcttcagatagttaggatgaaatgaggagcacatatgataaaagcatgtgttccaggactgagtttgaatgcccccttgtcccaaattggagtgtcttcaataagcctccccttattttcttaaagtattttatagggagtcaaaagtatttgtaagcatgcttatgccctccagagtttttaaaaaagaattcaagcaagaagaggtggatatggttggccaggtttctattaaatgactttcttcagaagcattttgacaaaattaggcacagccaggaaagcagcaaaaaatctgtcgtttctcatttgctgaaaacgccattagctgcctcttctcgccttctgctcacggacacttggctcttgttcctgctctgccccctgtgcccagtctggcagataatgcaccagaaaatatttcacctcatgcacagggagtgggaactcacacaaggaagtttgcaaggaatggaaatctgtgcaaggcaatcccctcgtcctgagaaggaccccatttagcaggggcgaatatccattaaactctgatgaaaacatactcatgcattcaataaatatgcagcacctacaaagtgctggtgttttaggtgctaggaatccattagtgaaccagaaatgaaaacaacaactaaatggatgttaaacaaaatcagtctattagaaggtaatgaggtactattaagaaaaaagaaagggagtcagagggtcctgtaagaaggggcaagaggtgtgcagttttaaatggaaagattaaggaagtctctaataagacattggagactgatcatgagtaggaggcacttatatcagagtttttgcagtttcgaaaatgcattttgcactttggtgtaatttacttcacaaacaagggatgctcttaaatatttgcttatttaataactttctgaatactgagggatattttcctattgcttttccacttcataattaaatatgaatttcttggacaaaaacaaaaggcctaaggaaaaggaaaatagaacttaagagctcagtaaaaaatgtttattttttctatcttttcaaaaataatatgcaaggcaaatcacaaaatgtgaaagaacaaattacttttatttttggattacttaacaaacaaaaggaaaaaaaatctctggtaggtagctcaaataaagaaaacatcctgaattaaaaagctatctaactttatccagccaccatcctaatgttctatcacagatcatgcctctgtgcaaaaaggcctgatttctgagagtttaaaagaatcttatggttttgagaaatgaatacactgatctcttgcgaagaatgaaaaagccccaaaactcagcaaaggcaacaattcaaactaccacaggaaatgaaaaagagtgtgcatttggaacatacacagagttttaaaaaaaacaaaaggaaattgatatagataactcaatttccattagtgtttcataaatttaaattgccttgtgatcaactgagtgcttgtataaactacaaagcgctggtgtggtcccaagatgagaatgtaaaagtataaccagaaaaattaacataggaatcaattaccctgaaaattctgatctcagaggtccctggacagaaaacagtgctccctggaatgacatgaaaagaaatagacaaaatatccatatccacttctatataaagagatactaatgcactgtatacacaacttgggaatatctgcacatactttgattagaagtgagtttataatgaacaatgctcatgtgcattaactcataatactaacactttttactggagattatcaagaggtcagtgatagccaaagacaccttttctcccaccccttcagtttccatgactacgtatctttcctaaaccaccctggcatcacttgactcactttcttcctccttggggaggaatgacttttctgatgggtaaatttaggaaggataaatttcctgctgtgctcaatttctttcctgctttgctcaatttctcctctttgtccttctgggagcaaattgccaaagaagcagaattctccactgcttccaagcctaagtgtcccctgggcaggaccactctcccctacaccgtgaactggggatccatccccatcagcatcactcctgacacctaattgcacacagcgaattttgtgactgtcagcatcactcccgactgggaggctgagtctgcctaattgtggacctaacctgcaggttcttgtgcttcttgcactaaccaaagcctcccacctggcttccatcattaacagagaccttttcttctcgttgcccatgtttctgttttagtccttatttgtacagaactgagtaggggtaaaggtgatgttatttactggctctctctgagggaccctgatagtcagaacaagagatgttgtcaggtatacatacagacatcacagtactaacattgggcatggatggaagcattaaaaccaacaagccaggtttgtctatcccatttacttcaaaaacacaccttaaatttttacttattttatcattttgttcatttgaaagtaaattaaaaaacataaaaatgcacaccatcaaatgacatgttgcagtgctgaaaaatatgtgaagaaaaatgtatagatgagcgataacaggatttataactcagtgacaatctcagctttacgacatttaaattgtgaaatctctaaaagccctaaagtgttgttcaactcatgtcttatccatttcagtttggcttaccataaagtataaacatctagttagaatattttgacagaagaatattggtgagtcattcaatttctctaaccgtcactttgtctgtaaaatggggataaaaaattttttctcttaagttgcacaaaattgaaatgggagcatgatttccgaataggccagacatggtggctcacatctgtaatcccagcactttgggaggcgaggcaggcagatcacttgaggtgaggggttcgagaccagcctggccaatatgatgaaaccctgtctttactaaaaatacaaaaaaaaaaatgagctgggcatggtgacacacgcctgtagtcccagctgctggggagggtgaggcatgagaattccttgaacccgggaatcagaggttgcagtgagccgaaattgcaccactgcactccagcctgggcgacagagcgagactccgtctcaaaaaacaaaaaaaaaaacaacaaaaaaagaaagtataaataataaaataacacactattacaaatgatcatcccttttgtgaactattattattcctattatatgaacactttttttttaaaactcagggagtcatgtaactctgctatatgtatttcttcaagttaaataacaatgatttattaatgaactcctacatgctcttaggaaaggtgctatgtgtactatggattaaaaaaaaagtagtgcatgtttctcacattcaagaagcttttatttaagagaagaaatgcaataaacacagtagaaactaagtaaaaagaaattaggagagtggattttgtgcagtgaaagaggaggttaaaaaataagagggcactagacatgattttaaggataactgagctcagatggatgcaggagagcaggctggtgatttcaggggaggcgaataagtgggaaatattagacgagaatgagcatggtgagagcgctggagtagaggggcaagttgattctctactctctgtttaacagctctttgagctttgttatatttcatcaaggtaaaatatatatataaaaaaaaagatgggtgccaacctctccacatggtgtttggttagatgtggcaaaagtgtggtttttaaaatctatgtaaagaactccatgaatttccaacttattatactctaagtataaaaattgctgaatatcaatgattatacactacaaaagaattgccatttatgggctttattaatgttctagaacctataagtattttacatacttatttatacatgtgaggtcctcagcccttaagacaaccttgtgaaaattggttgctgttttacatagagaagcttgagtttcaggaaaatggaatcactcatgagagaacacagaatgtgtaaatggtggaacaagaattcaaacccacatctgacttagaggcttacccacgatgcagtcaacacctgaccatagtatccaatgacaggggtggaaattagattttgacatgaagttaaaaacacagttaaagtatgtggttcaaatatttaatcattctgggagcatcattctttatgggtgcaatccacattctctttagagaagaaggatattactgtggcaacattcaaagaaagtgcacttcagcctgaagctcagcaagatcgtcttttttgggggggaggtggtaattaactgagtgccctggccttcatccacttttctgatgatttccccagctactcagggttaagcttctgtcacaaaaattattctgagccatttgtttagcctgtttgatgttcactacatttattttccttaggcagcagcattgtgaatgttgactatatttaacatgcttagctgtaccagggaaataatcatctttggcttatttaaaatatccaattttcttagcctttgaagaaaatctagagctaatatggagtaattggtgatgagataggacagatccaagtgcaatttcaaggctcctaattttcacctacagagtaagatttctttattatgttagaaaatgttttggagagattttttcaattaggaggcacattaaacaaatactggctagtagtgtacgggttcaggaagaggggtaaatctcttagttgcttactttctttcaagaaaaactttaaatgattctatttaaccaaagagaagatggagagaaggcaacataagaatgtaattaagtttaacttttaaccttctgtttgggatttgcctctattctttcccaccatagttaagtgtgaagatagtcctcatccatatttagaagaagcctcaaaaagaagcaaaggaaggaaagaataaatagaagtattcactgtctatcctatattcctgccaatatctgggagtggcctcaaaataatacccttgctatctcagagcctatattgcttttgatacactagcagtacttctgtggttttcacggaacacataagccaagtccatgactgaagaccatggcaccataaggaaatctcaccactgacaccatttataatgaaacaaatgggttttctaagaggaggtaactcatggtataactgtcgtggtacaaggtctcaggccaggccttcccacttaaaaaatttccctccatttccaatcttagcaattttacaaagaaactggtcaactttccttaaataattattccaggacttaacttgtgccctaaagaatagacatattctggtctctctggagtgtggagaatgagaagatttgttttcatggaaaaatgtatctactcattttagacagccattggcaagaatagttcctattattgtaaaatgtgtgtatttgaaatatattagctaggcaggtcaactctgaactttacaaagattttgcaactatagaatttctttgctgattttgtgtttttccttaaatatagccataaatgctgagctatatgttagttttattgttgatgcattgtagaagagagatacaataatactgaggctaacttactattttgagctttaaacttttagtctaaaatctcatctgtgcaaattcttaatgaggtacattttcaaagagagctttagctatataacctctgttgtcatgaagaaatgcatttggctaatttcctctgtgtctccttgaaactttacaataacaggaaaaagttaactctgacttttcactcaagtaatgtttagaagtttctgctaattccaacctcaatgcaccagagatatttagggattgctgaatattgggaagatagatgtaggatttggatgtttgttcaggtgcctcagtcttctaattattttgtcattatgcattttcccctgtaatttgtttaaatttggaatcacatcaccaattacttcattgctgtctggtcttcaatattctcttgtttattcattagagaatttctgtgacaggccattaataactatgcatttgctgacgtataaagtcacatatccttaattatgttcaaatatctgtctggggaaagtacttgattctaaatgtactatcctgatcttactaatccaggtaccttagtgtatgtcttcacttaccatagagatttagaaaataaaaaaagaacacttagtactaaaagtaagactagcatagaaaaaacttgagctctaacttcagaagactgtggttgattccaattctactgattgctagttcataatgtagtcaagttacttagcaaatttgaagaaatttccttatctataaaaatggaaaatacctatggactatctcatgtgtaacagaactaagcttattataacttacaaaagataaatattcaaaatcagcataaagaaaattatgtttttggcaactctattcacaatgtttgggattcttcctacctatagttatgtatgaagaagtcacactaaagtaaccattagaaaatctgggttacaatactaggcacttttaatgagtgcttaccatttaatgagtactaggtatgtggcttgtctcaaaattattctgtgtctcagaagcactctgtgaagttggtattatgatgattttcatcttatgggcaggagaactgaggttcagacaggtttggtgatttgcacaggaccacagccagcagcatttctggaaaaatttgacctgtgtatcttcaaagctcagtgtgtcctaaccttagtaccattctgcttctacaactaagttctagtattaagtcataaaaggaccctgggcaactcattactttatcatgacctatatcttagggaagtttgaatgagctttcatgtcttcttgctcaaagtatgcatgattattggtcttaaacttcgtcacatgaacacaataccccacacatttacttgagatgaacatgggcctgcctcttatgaaagatattactctctcgacacaagaaatggaagaacattccatgctcatggataggaagaatcaatatcgtgaaaatggccatactgcccaaggtaatttgtagattcaatgcaatccccatcaagctaccaatgactttcttcacagaattggaaaaaactactttaaagttcatatggaaccaaaaaagagcctgcacagccaagacgatcctaagcaaaaacagcaaagctggaggcatcatgctacctgacttcaaactatactacaaggctacagtaaccaaaacagcatggtacttgtaccaaaacacatatatagaccaatgaaacagagcagaggcctcagaaataacaccgtatgtctacaaccatctgatctttgacaaacctgacagaaacaagcaatggggaagggattccctatttcacaaatggtgctggtaaaactggctagccatatgtagaaagctgaaactggatcccttccttacaccttatacaaaaattaactcaagatggattaaagacttaaatgtaagacctaaaaccgtaaaaaacctagaagaaaacctaggcaataccattcaggacataggcatgggcaaagacttcatgactaacacaccaaaagcaatggcaacaaaagccacaatagacaaatgggatctaattaaactaaagagtttctgtacagcaaaagaaactatcatcagagtgaacaggcaacctacagaacgggagaaaatttttgcaatctacccatctgacaaagggctaatatccagaatctagaaagaacttaaaaaaatttacaagaaaaaaacaaccccatcaaaaagtggtcaaaggatatgaacaaacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaacaacagatgctggagaggatgtggagaaataggaatgcttttacactgttggtgggagtgtaaattagctcaaccattgtggaagacaatgtggcgattcctcaaggatctagaaccagaaataccatttgacccaacgatcccattactaggtatatacccaaaggattataaatcatgctattataaagacacatgcacacatatgtttattgcagcactattcacaatagcaaagacttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactgtcacaagggcagaaaaccaaacactacatgttctcactcataggtgggagttgaacaatgagaacacatggacacagggtggggaacatcacacgctggggcctgtcaaggggtggggggctgggggagggatagtattaggataaatatctaacgtaaatgaccagttaatgggtgcagcaaaccagcatggcacatgtatacctacgtaacaaacctgcacgttgtacacatgtaccctagaacttaaagtataataaaaaataaaaataaaagtaaatagagatattactctctctactgcctccctgctatttaaattcatctaagtaaactacatctactactaagtcccaggaaatatttatttgaatatgcatagcaataattttatgcatgccaattttcctcctaaatacagacccaggaaatacttcatctggtacaaaagtatgttattttttctttccatgaataatctaatgtctgcttagtaccagacttgatggttaaaatggatgtgataattgagaaaactgttagcccttttcataaagggagtgcatctggattgacaacaagaaagaagaacaggaaaactagtttcaagctccagtgagaatttcatacttacagaaaattaaaattcctaatattggtttaaaagccattagcattccagccctaagacaaagtttcttggaatcaccaacacccactaacactgagcttgccaacatgtcattagggctcaccttccaagtgaatcctaatcaatagcctgtcctgacactgcagtgacccaaacccccggttactcctcacattacagtgggacaggtaaatttgtgtgtcccttttgacatgcaaatttgctgcgtgtgtgtttgtgtgtgtgtgtgtgtgtgtgaaaagacctgaaacagttcattctcttgtcccattaattccactctatgactccatcctaagaacataattctaaatatataaggaacttcacacacagataattcattacataattttccaaatactaaaaaaagaaattacttattctaaaatcaggattagtaaactatattacacacatttatagactataatataggtattaatttatgaaaaatctgtaatctaatgtaaaaatacttgtgctctaatactgaatttaaatctatataaaattttatagtaatacaatattattaagtttaagggatcagatatacatggagaaaaaaactgaaaataaacaaatgaaaatattatcagcagtttttttttttttgagacggattcttgctttgttccccaggctggagtgcagttgtgccatctctgctcactgcaagctctgcctcccgggttcactccattctcctgcctcagcctcccaagtagctgggactacaggcgcccgccaccacgcccggctaattttttgtatttttagtaaatacggggtttcaccgtgttagccaggatggtctcgatctcctgacctcgtgatccacccacctcggcctcccaaagtgctgggattacaggtgtgagccaccgcgcccggccagcggttattcttagaatggtgggactgggggtattttcttcatgtttctttcttttctatttatacattttcctcaatgattgtttattacctttgtagtagaaaatcatatacttccccaacactcaggtttcatttccaataattttcagtgctttgatgttttcaaatttaaatttagtttgtaatttatgaatgcgtgtatatataaaggcttacaaattgtgtttggttatacctcaactctatggttctcaatgagggttaggggagtgatctcacctaccctgcacccactggacatttggcagtgcctcgaaacacttttgcttgtcacaactcccagaaaggtgctactggcatttaattggtagagaccagggatgctgtcaatcaacctatagtgccgaagacagcacacaactcaaagaattatccagccccaagtgttcatagtgccaaggttgagaatccctgcctaaaacaaaatgtttaaaaattattaatatattaattcaagcctgttgtgcaaattctgagtagcctattgtattaccagagcctctgaataaacttgcctgtccatgatctacctaacagttcactcactcccacagggcattgaggatggaaagataagtgctctacatatgcggtgcttgaaatttagcaaaagagaaagacatagacatcaagtgtttaatgcagtttgaagtgctatgaaacgggcacttgatctaactaggtggttcaaaggaggctttctggaaaaaatacctcctaagctgagcttaaaggataagaaggagttaatcagaatcatgtgaacacctgagagatgtgttctagaaggaggagcattcatacttcaaagaaaggcatgaagatgaaacagtttagagtgtttggaaaatgatggggagtttgccagcactagagcataagataggcacagaagaaagggagaaggagccatagaagtttcagagccagagcctctttttttctgcctgagaaagtcaaagtatacttctcagtatggggatgagattgagatcagacaagtatgttgatttaaaaagcatgttgatttaaaaggacaagtatattgatttaaaaggacaatctattaaagatgcaattgaagaacccagtaatacagccatacctcaaagatcatgtgggttctgttccagaccactacaataagacaaatatcacaatcaagcaaaccatacttttttttttgttttcctgtgaatataaatgtttacacaatactgtagtctattaagtgtgcaatagcattatgtctaaaaaacaatgtgcaaactgtaatttaaaaatactttactgttaaaaattgataacaatcatgtttcttcagcaatcttgcaaaaagattagcaagtataatatttttgctggtagaactggccttaatgttgttggctgctgctgatcaaggtgatagttgctgaaggttggagtaattgtggcagtttcttaaaataagacaatgaaatttgcctcattgattgaactcttcctttcacaagagatttctctttagcatatgatgctgttgacagcattttatccatggtagaacttctttcaaaattagactcaatcctctcaaatcctgctgctgctttctcaaataagtttatgcagtattctaaattcttagctatcaattgaatgatgttcatagcctcttcaccaggagtcaattccatctcaagaaactgctttctttgtccatctagaagacactactcctcatttgttctagtttgatcatgagattccagtaattcagttaaatattcaggctccacttctaattctagttctcttgctatttccaccacatttacagttatttcttctaatgaattattgaacccctcaaaatcattcatgagagttgaagtcaactttttccaaactcctgttagtgttattttaacctccagtaatgaattgtggaagttcttaatggcatacagaatggtgaatcctttccagaaagttttcaatttatttcgtctagatctatcacaggaatcactctttatggcagctatagccttacaaaatgtatttcttaaataataagatgtgaaagtcaaaattactgcttgatgcaggggctgaagaatggatgttgtgttcagaggcataaaaacaacattaatctcctatacatctccattagaactcctggacaagcaggtgcattgtcactgagaactaatattttgaaaggaatctctttgtgaggagtaggtctcaagggtgggtttaaaactttcagcaaaccatgctataaacagatgtgttgtcattcaggctttgttgttccacttacagagcacaggcagaatagatttagtatagttttttttaaaagtagtgcggacccaaagagtgagcaacagcaagatttattgtgaagtgcaaagcaataaagcttccacagcatggaaaggggacccgagcaagttgcctgatttagcataatttttaagtcaggcaaaaagttgacttcaactctcatgaatgattttgaggggttcaataattcagtagagaaagtaactgcaaatgtgatggaaatagcaagataactagaattagaagtggagcctgagtatttaactgaactactacaatctcatgatcaaactagaacaaatgaggactaacttcttctagaagggcaaagaaagtggtttcttgagatggaatcgaatcctggtgaagtctaggttggaatggtaaatgagtactggcttcaacttaaaatcatcagctgcattagctgctaacaagagagtcagcgtgtcctttgaagctttaaagccagacactgacttctcctctctagctatgaaacttttagacaacatcttctcccaatagaaggttgtttcatccacattgaaaatctgtttagtgtactcactttagctagaccttctaggtaacttgctgtagctactccaatagcacttgctgcttcgctttgcactcttatgttatggagatgacttctttccttaaacctcatgagccaaactctgctagcttcagacttttcttctgtagcttccttacctctctcagccttcacagagataaagagagttagggccttgttctgggttaagttttgaattaagggaaggttgtggctggtttgatattctattcagatccctaaaactttctccatatcagcaataaggctgttttgctttctcattcttcacgtgttcagtgaagtagcacttttcctttgagaactatttctttgtgttcacaatttggctaactggcccaagaggcttagtgtttggccagtcttgactttcatcatgcgttcctcactaagcttaatactttctagcttttgatttcaagtgagagatgtatgactcttccctttacttgaacacttagaggccattgtaggattattaattggcctaatttcattattgttgtgtttcagggaataggccggccctgtggagagggtgagagactggggaatggccagtcagtggagcagtcagaatacacacaatatttatagattaagtttggaatcttacatggatgtagttcatggtgctcctaatctgaactcgattattcctgaggtatatggtataaaaatttctctagtaataccaaagatcactaaaatatatataataataacgaaaatgtttgaaataccgtaaaaaattccaaaatgtgatacaaagacacaaactgagcacatgctgttggaaaaatggcaccaaaaggcctgctcagcagggttgccacaagccttcgctttgtaaaaagcccattatctgcaaagcacaacaatgtgaagtgcaagaacacaaggtatctgtgttatgcctgtatcattgagcctgggtaacacactccttatagctctggacaccgtgaaaatacagggaaaattcaaactgtactaaggtacagtgttctctcttgttcagctggagagaaaatgaatgaacacaaattaagtaatttgagggacagtgcatcaggattcattattaagtgtgtttgctgtaccacgtacatcaggagtaactgaattcagattagaaagaaagggtggtataaaagagagggtgggtttcacttaaagctgaaatggaggaagggtggcacttgtataggagaaggagttctaggaataatataagccaggagtttgaaactgagatcaacatcaggtgttcttggaaatgctaaggtaggttttttcaattgccagtggttctcaaggctgcttgatgctcagtgctaaaagtgttgctcagatgcagctcaaagatcacctctttgagtccgttctgatgctctccactttctaaataggattggtcagtctttcttttatgtccctctaaaatctacatagacgtgaggcccaggcaatttactaaactaattttttggtatgttcatttatatataaacccaatgtagccaaaattatgtctttatgttctcaatgactagtacagttcttggtacacagatcacactcgaaaacctttctttcctggatgattgaatacatgattatgctaataataggtatgatgactatgcaaagcaaagacagcaatgatgttaacactgcaaataatacccaatatttattgagctctgtgtgataggcactgtgctaaggagaattttaacaagtatcatttcatttaaatttcaaaataatgtcatgaggtagctacgactagtactccattttacaaatgagagaactgaggttcaggtggttatatcttcaccaagatcacagccagtaaaaggaaaagctggaaatgaactctaggtctgtctcacttcaaagaccatgatcttatccactacttatagatcttttatttttaagagagtgtagacttaaggtgattttattttattttttaacatttgttcattgaatgtatgtgtcctagactcgaaaggctcaatgtagtgcaacagtctgaatagtaatgtaattttaaaaattaaaatgggtctttaacaaatctatgaaataagagtttgcaaactcaataaaaagagtatattatcaacttctctaagagacaataataccgaaaatgaaaaccaataggacagggcactcaggcattgactcattgtatgacaataccaggcagatggcttaatttatataacaactatctaagttggtccagcagtgtgaagttaggggaaaggaagtcattttattgaaaaaacgcatgtgttaattcaaatcacttgacagtttggcagacaattccaccaaccgcctaaaaagagactagacccccatcccctcaatagtacagaagggatagaaaaacctagttaaatttccaaaaaacaataagtcatcaacctgagacccccttctcaatggttccctttattgccaactctagaacaagggctggcaaaatacagtggtaggccaaatctagtctattctcaattttggtatcacctgccagctaaacattgtttcacatgtaaaataatggttaaaagggcagacattaaataaatatattgtgacatatgaaaattgtatgggattcaaagagcatctacaatgttttattagaacatggccacacctatctgtttgcatattatctacggctgcttttgtgctacaacagagttgaggagttgtgacagactgcatggcccacaaaacccaaaatgtttactactgaaaaagctggctggccactgcttgagaatcaagctcagcaggtgtcagacaacttggcacagaacacactgcagataccatgggtttggcctttccaacttattacctaactcaatggttctcaaagtttggcccctggaccagcagcatgatcctcaagtaagaacccattagaaatgtgaattatgaccccaaccccagatttactgaattggaaactccatgggttgggcccaacaatctgtgtctaacaggtcagctaggtgattctgaagcattcttcagagaacggtagtcaaactcaagaaactggaacatggcaactgttgtttcaacacaattacaagaaaggcacttattggctcctatttgtggatgaagaatggagctagatattccacttatattttagtattcctacaataatcttcaaagattgggattattaaccccattatatggaaaaggaaattgaagcttgggaagattaagtaacttgttcacagttagtgaattaggacttcaactcaaatctgtctgctttatagcctatactcttccctctcgccttattctgccttctcccttattatgtgagagaaggagaaaagcacctgtgggcccctggaaggagctgagctgatttattagttaggtcttggtgttttcttgatgattataaaccatttcatagaatatgaacatcagaaaacaccactgtggacccatggttgatcaatataacaacaagagcactctataatcatgtttgaacagaagcaaaaagatgaactttttctcttttttttgagatggagttttgctcttgttgcccaggctggagtgcagtggtgtgatcttggatcactgtatcctccacctcctgggttcaagcgattctcccacctcagcctcccgagtagctgggattacaggcatgcaccaccacgcctggctaattttgtatttttagtagagatgaagtttctccatgttggtcaggctggtctcaaactcctgacctcaggtgatccacacacctcggtctcccaaggtgctgggattataggtgtgagccactgcgcctggccaaacatgaactttaaaccacaaaataatcaaatacctcctatcccagctaatatgagtaacagctgcttctttacctattacagcttttgtctctgtctagtcttcactacttgcagacacaagttacccaatcacagcatgactctggcttcttgacagcttcctgtccaggtcaatgtcttgctcacttaaaccttctccaaaggcaccaaaatgagctcaaaccctgtaataagtcctaacactctctgagacattccccgtttctctgcagcatgtattctctctctctgcaatgaataataaatgaaaattattcaaccacaggtgtgtttcctgatgatatttggctggagggcattccccttccactcccctcactgcccacttaaaattatagctctcctcttccagcctgggtgaggcacaagttaccaaagtaagtaaaaataattagaactggaaaataatagtccccagactaatcagtatcaagcacattgccaggtccaagcagaaacttggtattttaaataattaatgaaattttcagtgccaatctgattacaaaaatgatttcaggaaactgcctgtcttttaaaaatatagttcaattttctgcttttagtttctagtctctacctgtcaaagttttggatctctcaactcttgagatgtaaaatgtcacttatctttttgcagccttccccaaaatcttctagatggctcctctctttgagttttctaaaggccttactccctctcacaatactttttcatcttggattagttattcatgagctgtctggcctctaaccaattcggaaatttcttgaaggcagtaaaacacctgactatcctcccttcccttccacacagtaatacatatttgttatattttggcaataaatctaaacgtttttccagttacagaattgaaagtgttgcttttccatcaaaccagagctcatataagcggggactctgcaactcattgttggttatcttaattgaaattatctccctggctcaggagttctaacaaacatatgtgtttggtgtgcaggtatcttcactttgccaggggattttgatgtgaaatattactaacagaaaaaatatatatataacaaaaatcttaatcaatgaatcaacagtttttaggctactatggaaacctgaaagtgatactggaagttacttattatgtgggataaatagatatgaactggcactattcctgtatgaaagcaaatggcattcaggtcataattttcttcagtaacttctatttaccaagcactgtgctaaacagcaaggataactgtacaattaaggagaaggagtaaaacagtcaactcctatcctacattttatcgttgttccaggaatttcacgtggtgtatcatggccctgtgcttgtacatggtgttacctcacccagcgttttacatacagtacttggataagcaccattcttatatatcaatcttatacacttctcttcatccataaaagccaggattagaggtcacctccaccatggagtcatctctgattgctttcatctcctctacttggacttaattacctaacattcttcttggattttcttgtactggtctatttaccatgatgtattatattttttatttgttagtattctttttcttcttatgcaactgagaatatcttgaaggcagcaactatctttaattgatctctatattctggagcctagcctagtgcctgacatcctgtagacaatcaataaatatttattaaatgcaagccatgtgaaaacaagtgccaaagtactggtaattattaaagttagataatgaatatatgacaattcattacacttttttctataccttgttttatgtgtaaaatttttcaaaataaaaagtttacaataatcgaggaccttgtaagatagcggattaatctatccaaagttttaagttccttccactatacctatagctatgatctctgcgtactccacatttctttcttttctcataaaaaagatatttaataaagccaaacaaagttgctctgaaataaagtataagtatattgtttccaaagagcttcatgtcatggatatcattaaataagaacttctggaaaaactggaaacggacagttctccccaagtattttattgaggagggaattctgtggatttttgtccttccaatctgccatctgaattgctacaaaagcataactagtatctctgcttccactttctttctttttttttttttttttgagatggagtctcactctgtcgcccaggctggagtgcagtggcgagatctcggctcactgcaagctccgcctcccgggttcacgccactctcctgcctcagcctcccgagtagctgggactaccggcgcccgccacctcgcccagctatttttttgtatttttagtagagacagggtttcaccgtgttattcaggatggtctccatctcctgacctcgtgatccacccgcctcggcctcccaaagtgctgggattacaggtgtgagccaccgcgcctggctctgcttgcactttcttacctgtgaactcatcttcacctacccccaggttgacctacctaaaacatggatctgtcccacttgctcccccaaagttgaagtctttaagtcaatggctcttcaatgtttagggaataagtgtgcacttctagtgttgaaccccaagtaacttgtccagccacatattttaatgttcttagacccatgtgcaacgagccatatccaattcacggtcctaatccatgcaagccacccactgtctgtgcttagattcacagctcaatttccttgctcagcttggaatcttcttcctggattttccaatttgggaaacattctcccactccaaggtcctgtacgactagtttttcttctccattaaaccttctctggagtcctttccagaatgaacctttctacctgtgcttctactggccatggcctgggcctatgcccagcattattttctgctgccttgtttagtaagtagtctcctttaccagaatgtaagcttgttgagggcactttaatgttcatcttgcactttcccaccctctcagtcaatacccaacagggtaccctgcacacgttagaattcaatatgacaagattacaaactaaagtatgaaatgatgagcttaatctcatgagtgttctttctccttccgcttactaataagtggatatgtgcaaaatttcaaatccctatagtaaaatcacactggttgttttgatcttctttacaaattgcttttgagtcctaagtcatgaatttcaattaaaactttttttaaaacaagactatcgaaattggaaactaaaacaaataactgtttctcttaacccttttctatctgtgtctaattctagtcaacattagagatgaaaatattaaggcaatactgctttatctcaacattaatatgggccctctcattcaaatagactcagaagtactttctaatgtattatacagaaaatcacactggagaaaatattccatgatggtaccattgaggtatcactgcttcctgaggacaacatgtaagctcaatgctgcctaaaagaagctcaaatttctactctgggccttttcaccttcacttctccaccataaaaaaaaaaaaaagaggctaattctctggactattgtgggtcatattttctaggtggtgcaatcttagtgaagagtttagcaatttgcattgggataaccctgtcaaccttcatcattttcagctagaaagaatgaaagctctgataatctaattttttatggtggtttgcactttagctgcctttttttctcaaacctttacttgactactgatcaaaaagtccaggttctgtttctgcttagacaatgtcatagtctaaataaacaggcagcaggcctaggatagaggtgtcaccttctcattggacttcatcctcagactctgcttgaactggacattcatcatgattgaatgtaagtcacatttggtcaaaattcagtgcagatcttagatgtctgacaggggctgaggagaccacttggcttgcttttgtcctaatcttgcctctaatctatgacaaacatcagtggtctggcttagctcatttatatcccatgcttgggtcccattcctgggttgaggtcagagccttgtagaaattacatgcccattatatgattttcttttaaatgcatttgccgaaaatatttcacatggtattagccaattcaggaaaagactcaagaattccagaaaattcccatgtgcattttcatttattccctttctcaacattaaggaagatgtataaaagtatgttgtagtaggaaaagcactgtgtaggattcagtagtctttggttttgatcctgcttctgctcgcagttacatttgccttatgacaagtcagttaactttactggattgtagttgtctcctatgcaaaataagagttggcccaaactagtatttcctaacatgtatttcagaggaaaaagggactgactcaacaagtatatgtgggtcttccctcatgtatggtgataacctgcatccttgtattttaacatgatcatggattctatattgaattaaaagtttctccagcttactgaacatttcacataatatctataaatatttatgtacatctctatgtgtatgtttgtgtgtgtagatatagaaatatagattcagatatggataggaatatgatttagatatctctcccaaggaagacttttcagaccaactcaaaatttctatgattctagttgggggagtcaggtttacaattctaattttcattttgttgaaactcaaattcgaagtttgaatctgcaaaccttcaactttaagtgatatgaaacagacattgaagaataaaagctgaatcgttgcccggggccttacacttgggacttttgattttaaatttctacattattaactttgacaatataagaactgtgcgctatcctcataatgctgtgaaagttgacttcctcaatacatttgtggaggttgtcctttagaacctaactctgaaaccaagtcagctccagtacaatgcactgaagttgggggctgtggctcaactaagtccagagaaccaaaacgtggtgacaaaacagaagcaaattattccaatcatagaaattgaaattgctagtactgtattaagacaccagcatttagtgcattgaggcagaaatctcaagagaatgcaaaattgtgtaacattggagaaacctgcttatgcattgatttccttcaggggttaaataaaattactgtgaaatataagaaaaggaaaaagaactaaattctgaggttttaatcccattacagtattatttgtattgtgtctaagcagaacttattgagaataaagaagatacgaagattacaatagaatgtatgttcttatattgtctaaacagttagaacctaatgaacttactttgtagaataaaaggactttctgaagataagatacattggccatcattaacatattaagagaaacaacctgtataccggatcttgtttgggatgatgtcatcatagctatcaggtcttagctcctatagttagaaagattacagaaagcataggcaagtttaaatatttccatctccccacattaaacacaatgtgagaggtaaatattcattacttggcaataaaatatcatatccatatctggaagaaatattagcaagtatctcatggacgtcattctttcacttaggaagaaagaggagattgcatgtagaattgatatcaaatgatttaggtttaaatgattcaaaggctattattttagtaaaagcattatttcataaacaatatgtgtgtgtgtttgatacatacatatacattcaaatagttaaagcaaagttaattaacttcttaaaactctccaatctttgaataacaaaactcattttggatagcaagagtaaaatttatgttagatggatctaatttttattgatagcaacagtcctgtctcgtgtgtatgagttcctactcaggacacacatgagcaatgagactcactggggaatgcaaatgaaacacttgcaaatcaaatgttcaaagcacatttttgctgagcacccattaactcaatttcatatcaaaagcttacccattttatatcataataaaccacccgggttcacccccacacctcctaactaatgagggacacacagatattctcttcacaaatcaagatactctttcataggatgaaatcactaatgacattaaggtgtggtaaccaacatgaacttgacaaccaaataccaacccatattatcaccccataggagagagtcctaactccccaccttagaaaaatatttaacccacaaaatactaaacccaagtagatttcaaatagaaagataatggtacaatatcccttcccttctaatatcaaatatctagataaaccaaaatgaactgtccagccactaggatgctctatgccaaacatgcatattttaaaacttttactttgagtattaaggcttcttaacttctgcagcatctgtatctacttctaaaccagacctgcccaacagcacagactggagcgaccactttaccttccgaaaaatcaatcagtcccagcaaatgaagaagcttcagagatgcacatataatcacaacaatacccactgtttgcagtccttcggactcccactccagagtcaacatcctctgagctggcagagcatcccagcctccagacccctttggagtggagggagttaattacagaatcgtagcaacgtcaggcttggaacaaagacttgcaaggggaaaaagtgagcagctcctggcagatgcaccctgcaaagccggcggccccccggggtgaggacagacctgggctaaagtccagcttctcatgctgatcctggcatttggctggcggggcttcccccctgctaccacagcgcacggacctctccactctatgctgcagccagcgggcgagtacttcgacttcagagctgcgagggaaacgtctgtcggagaactggagactttgcagtgtccgtggcgagaagggacactcctaggaaacttgcccgggagaacaccgcgcgcttccctcgctgaggacgcgaggctgggcagatctgtctgcgcgctagttttctgcctgagaagcttgcgaatggcccctttttgccaaagctgctgctctctcctcccagagccgcctctggcagagagctcagctccctctctgaatgctaggaaacaatcagttctggtggctggtgcctacaggcccttcctgaaagcccccgtggaagtctagaggcagcttttccagggagaaaagtgcaggagcaaagctccgtgattcaatgactttgtcaaacgagaacacctgagcctcccccgccacgccactccttgttctggtctccgctgtcacgtcgggcgcattatcagggagattgatttagtccttatattatatttacaaaggtggacggagggcgtggcggagcagtacccggtaacaactaagatgttcataactgccccctggaaggtgtgtaccaccatcgtcctttaaagtctggcctcagcctttctcaaagtttcacaaacttccctgatgataaaaacaacctggggttgtttattaaaaccacgctcatcagaggagcctggagtgtgtgttattaagaagcccaggtgactcttatcaactgggaagtgtggacagcaccatcgcaaagatgccatgaggtgtgctagtccaaaccactccaaacagaccctgttctgtgccaggaccacactggctgaatcactttgttggttatctccagtctactgaagcccaacctaaaaacggagatgaagagaatcaacagggactctgtaggtgaactggaaatataagggtttgtgagtaatatctcagacctccagggtcatttgcaagttctgcttctttcttgctatgtgatcttgtgcaagacacttaaccactctaataacaggtcctattctatgcagtcaagatcataatacttcatttaaagttctccatttaaagggaattatgggaattaaatgtgatcacaataatagttaacatgtactaagcacttactatgtgctcatcaatattgtagtgacttttcaacaacttacttatccctacatctctacgtggtagacaaattaatctaccacataagtggcagattataagttaattctaatcattttaactttgtaggtgaggaaaacaaagcatgaagaggttaactgacttgccaagcagtgggcatagtgactggaaggcaacaggctttcattcattcagttattcattagcatttattaagctgctactatgagctataaatggtacatgaatgatcaaatgatgaataatactcagctctgtcttttgggggcttatagtttaatgaggaggcaggcatgaagtaaaatgtgaccaataaatacaccaacacttgaacagatgtctgcgcggtacagtgggaaaacaaggagggaaagtcaactctaattgggaaagggtttagtggtatcaggaaggagactttatagaggcggtaactgtccataatggtaacctgaatcattactagaagtattatagtataccatgctcaagttttgaggttggtagacctgggtacaatcctagccttacccttgcttgctccatgaccttgaagaatacactccgtctctgaatcttggtttaaaatgggaatgctactgcccctttctcatggttgatgtaagaattaactaagtctgcggggagctgagcccagtccctggggtcccctgctcacatatggtagttgtggggttatgacggaagttccaactcttcagaggctctgcaaggtctccttggatgaaacgactttgcttttccctggtcctgccacccctgctccaaggtctagtttcagcgtttttcccatgaagacctgctgatcatctcaacccacagtgtggtttctttcccttgagtcctagaaataagttggtcctgccaaaggtgcttttcattttgaataacatatttataagagatatccttgtatccacctgcccaatcacccatccatccaaacattttcttctccattatatcagcaagcctgtggcggggaagcaggttttagtaattagtaggaaaaaaaatattttaggtaaccattttctgaaatttccaccaacgtttagctacagaaagtcaaaagttaaaaaaaaattacagaaattaattaggtcaagttaaatgtaaacatgtcttttaatcctatatcataccatattgtagttgaaaacaactaaagtactgagagggggtcacatggttagaaaacccagaattcaatcattgctttgtctggcttccaaattcacgcttttccctttatttctatcagcagatttcagcaaatatttgccaattgatctcttagtttagagagttggtaaagtattttaaaattgccacatctcattttccaggattgaaattcctatcttttttgaaattcacataaagtcccatgaatatgattttgttggtttcagatagaatttcccttcaggacaatagcattctctacttagaatgtgccagctgattggaggtccagccctttcctatctgcattagttacatttaccacatgctttctgagctgtctctcagctgtggctaccggatcgaatctgctggctcccaagtatgcgggggctctttcacatgcacccccagctgtgagattttgtaaggtgacagcaccataagaggagtttcctgcttcatctaaaaagtctagggaagcaggggacatctggggaatgatgtttatctagcgccactcttggaaagaagagttgcctgcatagcgctttgggaggcttaggtgggaggataacttaggagtttgagaccagtctggggaacatagtgagactctacctctatttttaatgtttaaaaatttaaaaaagtaactccagatcacggctcaaccattttactgcagtaacttgctagccccaacccagtttgttatattaaaacatcctggctttctccctcattcactgactcacccctttctttacattgtaatgagtcctccagcagaggtctgtctttcataccaaagaagggaataccaaaggtacactaaaggcttttacccattgattctaagccaggcaccatactatgtagtttacatgtataaattagtttcagctcaccccaaatcaataggttaggtgttattatcactatttcaaagaagaataaaaactaaggcgcattgggattaattaattttcacaaaattacattcaacaagggacataaccaggatttatacctgatttactccaaaaatagtagctaccaacatttatggagaacttttaagtgtcaggcactactctaaaatatttatagatattggccgggcgcggtggctcatgcctgtaatcccagcattttgggaggccgaggcaggcggatcacgaggtcaggagattgagaccatactggctaacacggtgaaaccccgtctctactaaaaatccaaaaaaaattagccgggcgtggtggtgggcgcctgtagtcccagctattcgggaggctgaggcaggagtacctcgtgaacccgggagacggagcttgcagtgagccgagatcgcaccactgcactccagcctgggcgacacggcgagattccatctcaaaaaaaaaaaaaaaaaaaaaattatagatattaactaatttaatccttttatagttccctgaaataatttggtttcaaggagaaaattcaggctttcaaaggttaatccacttgcctgaagcctcatatatggcacttggtagaactgggatttgaatgtgggtatactcggtaccaggttctgcctactttatcattcaccacctcactctcaggcccctctgcaccatgttgaatggttctttaactggggccgtttaactggttgagagactctgaaaggaaagtattgacagaaactcttaggaaagtaaaaactcactccaaggacgcatgtccaaatcaattgaccagtctgtgaaagagagagggtcagtagactttacatttccttgccccaatccattgtgatcctttaaataatctcaaatgggatgatttatctaaaacctgaaattgatcatttttccttgttttttatagcttcagtttgaaatttcaccacgtgatagtctcggttaagaaatattcttcatactgtttgttgacattataataaatgcaaaaataagtgtagcaagattgagaaaaacgttaaaattcgatatatttacaatctacctgttctctcttcaaatacatagaatcacaatgtatatagaaactagttaagtcaaatttaaatgtaagattattagcctatgaagggaatcagaaaatgttactccaaaatatgtcctttggcataagggttattttcgattgaaggcaactgaaataggagactcaggaaaaactctctaccttccccctctctgcctcaaggcaggggatagatgtatgaatttctctttgtaaagtattcccttctgctctcctgtatgagaaggatgaaacaactataatcactgggcagaaagtcggcaccagtgggatttgtgtaagaaaccttacaaataagccttatattccattagtttcccctgtatatttttcttcccacaatttaccaccctagaagcccaaatccttttttctttgtcttgtcacttcacaatttatcaccctttgttaggatgattatataagtccccaattctaagcacccctttgagttactcttcattgagttctcacatgtatatgtgctctgcacgtgtaaataaactctattaatctatttttcccatcaatctgtcctttgtcagtttaatttacagggtccaactactaaatctaagaaggaacagagaaagtttttttcacccctacatccatattcatacaatcttttaggaatcatttaaagataaaataatatattttttaaaaatttgcaaatgcataaaaaggaggtatagagagcagagttggcttgtttaaggtcagggacttggaagtggacacaggtggctttgaatcctctagcttttcataatccttgacttgcttagtataggaaaaatcaggatgatacactgaaaagttaaaaagaagtaaaattctagaaggaaaatttcttctctcagtcaatagaagctaagagaagcaagccatcaggatggttggcattatccggaaggttgcattgaagagagaaacctaatctaggtcattgaaaatgagtttggagaggagcagtgactttcccaggaacataaatgggcacacacaaagacagcattggccaggcactgtgactcatgcctgtaatcctagcactttgggaggttgaggtgggtagatcgcttgagttcacaagttcaagaccagcccgggcaacatggagaaaccctatctctacaaaaattgcaaaagttagctcggcatggtgacatgggcctgtagtctcagctacttggggagctgaggtgggaggattgcttgaacctaagaggcagaggctgcccgtgccactgcactccagcctgggcaacagaatgagaccctgtctcaaaaacaaaacaaaaacaaaacaaaagacagcattcacgacagtggtaaagccagattgagacctccaagccaggcgagaaaaatgagattggatagttggtgaaagatgccacttaacatcaggacttgatggggcaagtaacaaagacaaggtcagtgtatgacccttcatgtctcttcacactgtaagattttctcaccaaaatgatgaaagttatctacccgcaggtgccctctactctaccctcaacatcacctccacattaaagtatatcaagcctttctatcttggggtttctcaattactttgaaaattcctaaatgttctccagatgaactttctgctcaaacatgatcagactcaagcagtttcacttagctgaaggctcattctgaaaggttagtaaatgtgtcttgaatggacttctttaaaatatgtatatggatgtccattaaactattaagtaccacagccttctgttttgaatgccctattgaatccacaaggtcgattggattttcaaatagaaagctgagggaaaaaactaccttccatcctaagacacttccagcaatattgcactaatgtatcttgaaaatagtcctcatgaatcttatgatcaaagcatgtatagtatgtaatcttcacataaacaaatgagtagactatttggaagtccaaccagaaaacttgcattagaatataagctttccttagtaggatttatgacatttttgccataatttctttttcccagcctttgtggcctaacctgaatgagttcctgggtttacccatttaatccagtatgcaatttgtggctctcctgtcatatcccttttgatgtaatctctctgtaataggtgtctgtcacatcccaccacactgggctggctttaaggccgtgattctccaggataataatgatcattatcccttttatatattatagtttgtagtacaataatactgaattcctaccacgtgacacacagtgtgctgtgtgcattacataaactgtctcattgagttgtcgcaatatctcaatagaataactaatcattaaccccattatatagatcagaatgctgagatgcaaaagcttaagtaacttgcccaaaactacagtgttagcagttgaggagctgggacttgacttcaagaattctcactcaagagccagggttcttacattggaggggaagtatgtgtcaaagtcatcatttttgttttgttttattttattttttactgtggccccattacacaaagagacacaagatttaaaatgcgaatgaccttcagaaaagtaggatgtgacgttaacctcatagtgaagtgtaaatattcagtaactagttctttcctgggaacaaggttaagagagcaatgaaaacacaaatgagatgagggaaggagctcgggatagaggtgagaggaaggagaaaagatgaagggaagggagaagagaggaagaaaagggaaagcgagaaatgagaaagagaagaaacaggcaattctttactccaggcactgagaaatctgaggatacatagatgaatggggcctgtgttctgtttgtgagattctcatagatggccagggagacgtgatctaaaatgaataaaagagggctccaggaaagggccgatcaaggggctatttctccttcaattaatcctacctccgtggtccaccagtctatgcgtctcttataactagaaatacagaatatctcatcagcttcattttctcagccacagcttcagatgaccttggaaatggaacaagtggttttaaaagtatgacaaatggcatctccatggatgttgtagccatggctggggcttggtcctacttctaggtctgttcctaggccctgtcataccttcctgctcatttgggccagggccttgctgccatagatataccacttcatcagcttgatcctcccagttcttgggcacgagattccagagactgacttgggtgtcctcagagctgcgtaagctcatttcttgcaccacaacagtacttgggaaacagaacccagcaggctttggcttaaatgctttccaattctgaagagaaactgaatgaatatttttagcatattttgttgtataggagttgtagagactgtgttagtccgttctcatactactatgaagaaatactcgagactgggtaatttatgaaggaaagaggtttacttgactcacacttcctcattgctggggaaattcccatggcctcaggaaatttacaattatggcagagggcaaaggagaagcaggcactttcttcacagggtggcaggatggagtgggtgcaagcaggggaaatgtccgtcacttgtaaaaccatcacatttcatgagaactcactcattatcatgagaacagcatgggggaaaccacttctatgatccaattacctccacctggtcccgcccttgacatgtggggattatggaaattatggggattacaattcaagatgagattttgggtgggaacacagccaaaccatatcaagattatatggaaagaatatttcatatagttcccaaaactctcctccccaaataattccatgtgctttctcctgtctccctccctttctgcctctcccccaccccacatacaattatcacccggatcggatcattttccttatctatgagattagaatgggtgaagtctcaatgacttggaaatccccttttcaccaaccttagagccctgaacattctcaatggatgatgaacaaagaaagcacagagtaggccgaacatggtggctcatgcctgtaatcccagcaatttggggggccaaggcaggtggatcatctgaagtcagtagttcaagaccagcctggccaacatagtgaaaccctgtctctactaaaaatacaaaaatcagccgggcgcggcggtgggcacctgtaatcccagctactctggaggctgaggcaggagaatcacttgaacctggggagtggaggttgcagtgagccgagatcatgccactgcactccagcacaggcgacagagtgagactccatctcaaaaaaaaaaaaaaaaaaaaaaaagagagcacagaataaatgtttagagaatgcctaccagaatgcagggcatgggtcatggtaggccttcactctctaagggctacctatctgaggtcatggcacaggactgggagccagacatgtagcctggtttttggaccattagtccagttctctttccactgcaacagggtatgaagatgtctatataatagctaagttacaagcaaaaagggaatatgcactatagaagagatttcttatagtgagaagatcaggaaaatcccagagaaagagaagacatatgaactggtcatgaaggccaggattaatatgacctgtgtccatattactgttcatgaatgcaaactcttgctagtgctccctaaatcagaagcatctatgaatagcttccaagattcattgtaacccagcaatcagtgaagctaggggtcacatcccaatgaatcactttgacaaaagggactaagccctcttaaaagaagtagaggaagaagaaaagtttcccctacctcagcttcaaatacagaggcccagagaactggaaacaaaatcattcttctgggaatgagttttcctagaactcacagtcagtgttgcagcttatgtgcctgagattgcttattttctgttattgtacccattactataatgctgaaatcagtttgtatttgtttcccgttgctgctatagtaaattaccacaagcctggtggctaaaactgacacaaatttattatgttacggttctggaagtcagaagtttgaaatggttctcattgggcttaaatcaaggtgttggcaggaccacgttcctattggaggatctaggagggaatcaattttcttgccttttccagcttctagaggctgcctgcatatcttggcttgtggccccttccattgttagtgccagcaatgaccatttgagtctttctcacattccattgctctgacactgacccatctacctccctctttcttttatccttgtgattacattgggcccacctaaataatccaccatacaattcttattttaaggacatctgatgagcaaccttaatttcattcacaatactgattaccttgtgtcacataacccaaaataacacaaatttactatttcacaattcctgggtttaggatatggccatctttggggtttttattctgcctactatatagatgtaatatattagttatttttaacaggaaacactctttaagaagaaaaaagataacataaactgaagctcacgaagacagagtccactttattaggaacaaactagttgaggtaagtgcatgtgagtgtgagaatgagtgtgtgtgttttatttttaacatacagaaaaagaactttgtctttgagaaggaaagggcagctttaattagcattcctatttctgaactaattgtcacagagaaaggactttgaggaaagtacatttcaaaatattaaaaagggaacactaaacaatttagagtgtataaactaatgatcagaccgagggacactctcctttcattttaggtgcaagcccagacatgaactaggagttacagggatagaaccctacagtacccagaactgggatgtgttcttcccacaaagaatgtcctagaggattacaaaagaaaagagaggagaaactactgcataagtagagaaaggcattcgcatgttatcagtcccatcagctaattcagccttcttaggatggataaaaccaaaaatgaactaaactcttcagctactgagtttttcatttttagttcaagtgtgcaatgctctgaacatgagaaagccatagagcatgactttcaaagacatggtagcaattaaactctaggaaatggggggctttatcctttgaagagccataagacactttctcctaacactgcctttaaatgtgcttgcatcttatacatttcagttaaaaatcagctctaaccccttctgaatgtctacttttattcatgattttcctggagtaagtttacctatatttacacttttccaggctttctctcacttgttctttaccgtaggctattttaaaatgagaaaactgagactaaaaaggtttgcatgatctgaaatcaaaaatggctgcaaaacagggttaaaaacaggcattctggctccatgccaattttagattttttttcttttctagtcttatagagatctttttctctgttgggtgctgtgggaagtgctttatatcagcgacttataaaatggggataataaaagcatctatctcacagtgctgtcaggggcaatgaatgcgttaatgtagttaaagcattcattgcaggcacaaagcaaacactctgtttctaaaagtaattatttttttagtagccatctctgaggtatttcgattattatgcccatttgaccaataaactgtgatccagaatggttaagacacttgttacaaagctggtaagtgaagctggaactcagtcctgctatgagaacccgttcccatttgcacaagccacactcacattgcctctctggtttcaaagaaccactctcagtcactcagctagttcttggcttccaagcaaggcagagcctaaactaactgagctgtattattatacttcatctgtttgacaagatcctcagatttcgatgccatcgctcagtaatctcttctttatctgaggactttgacctttgcataatttccacctcactgcatttgtgcaaaaaaatgttgacaccggttatgtaccatgcaaaatatgcaagggactgtggggcatgaagggtgtgaggaagcttacagcccagaagaaaagggaaggaatgcacataagttactaagtccaaggaaaaacattagtgtccatgagaaaatgcgtttaaagtgtggtaggatttcaggggcaggagaggagtaagaaagtggaagggtgatgttagtcagggagtgttgcatggagtctgagcttgaccatgagtggcagctcaatcattcctttaatgagtcaattaacaacacttatgtctgctatatgctagaatatgcaagaccctaaacaaatccaatcaacaaatcccattggttccacctccaaagtacattctgtatctgaccaattctcactaaccctgctaacatagccgtaggcccaagccaccactcagcaaactcctgtctaattttgttactttcgctctcacacccctaaggtctatttttacacagcagccagattaaagagcatatctttcatataatttccctgcttacagtccctcaatagctgtccattatattcgggataacattcaaacttctcgctgtgttttgagtcctcttggatctcaattcagaccaatgtaatcctgtcccacacctcctcatcacagttctctgcccacatagtctttcgatttattaaataaactaagactatccctgccactggtctttgtactttgtgatccccatgtgatgttctttaccccaagattgtccccttatttcttagactgtctccttattcttttctctttcttgccactcacttctaggctcaaatgctgtcttctcagagaggcctttcctgaccacactatcagaaggattctgtgtttttgtcaccactccctggttcctcttgatcaaattgctgtttttttatttaattttctccgtagcactcaccaacctccctgaacttcttttttttaaatgcctcttagcacgttcatttcctatctcatcccacttgtgtagatgctcctcacatgtgggccctttaccgacctcattcatctcactgtctccaggaactaggagagagattgtcagttacaggctttctataatgatttgttgaatgaatgatggcataagacagggttctttcctcacgcaggcatttgaatctcatgaagtgcatcagcaaaatcataatcagagactggcaagtaattttattaagtagtgcagtgggttcaagggagaattcattagactaggatggggggaaaactacgaagacctgcaaatatctataagagagtggaatgaggaagatttaatgatcatttcaggcagttgacaggcatgatcatggcagtatctggtccgtttcatctggtaatagcgcaaataaaagcaaccacaaccatgaaagaaaagagaaaggaaacaagagacaggaaaaccagtgagtaggctgttgtaatggtctataccagatgtcctatcagtgggcagaaagggactggacacagaaaccagcaaagctgcaaagctgaacccagcagagcatggtagcgtatgtgaaggctgaggcttcacatgtcctcagaggctgaggacaggaggtatcaaaggtgatcttaactgatggtgaaacatgttggacgtattcttcaacatttcactggctctgactagtgaaataattaaaaggtattgtagggaatctgggataactcattaacacgaagaaagaactgcacaaccaagacttaggaagggctgggaaagaggacgctgtgaatgacctgcagcaggaacttgctgacctctacctgagagggctgcccttagcatgcttctctctgggtgttcttgaccatggcatctacccaactcccagtcttcaagtttcaaacatcaacgaggaagattctgtatgtaggtcagacgaatgccgttggatcaatctgttattgtctggatcaatctattattgccaagtacaaaagagcactagggacccgctcctaatgactggggtccttttaggacaaagaaaactcttgaagggccatacagctgcttcaagtcacctcgggtgaaattgaaaacaggaacgtgtagagaggtgaagataattgaatttttgataaagttgttcttgagaaaccatcaggtaatccaggtagagctgttaagctgataacttaaaatgtggagctatgccttgggaagagggccagagtgagagagaagataatctgggattcatccacataaaggagataattgaagtgacagtagtgaatgagatattcagggaagagagatagaaagagaaaagagcaaataatcaaccttccagaagaaagggtagccaacagtgccagagcaggattagtaagtgagatgtaaggagaacctagaaagtaatgtttcatgggagtcaagagaagagagagcatcagagacgctggatcattgagttcactgtagaagccctatcaatcccaagtgaaagtttcgtcccagcaccaattagctttaggcaagtgtgtgtacaggggccatttctatgtgtgtgtacatgtccagaggactgaagggcaggggtggaatataaaagataatagttaaaaagatttcaaccataacatgtgatctacaataaaagtctatagccacactattgattacctataagggaaaacttccataaggcaactagactttgcttttacattattttgacaaggttcatgaatagataagagaaagtagatctgaggtccattggtctactgaagttgtcttcaagtctgaaagagtgaagggctgaaattttaattcacatctcattccttttaatagtctggcttaaaaataagaaaacacttgtctcttcatcagtggcagaagatgaggacagggtcatagatctgaataaggataatagttctttgcaaagaagtactccaaatggaggatgactcaatgtcttgacaccagtgagaataaattgcacagtcggtgcacttaattgtaaagttcttatgcttttttattcaatccaagacaattcaacaagtattattgagcatccagtaagtgcccaacattgatgcaggagttgggaatatgataggtacaaatgagccagctcttctttcttggagcctacagtcaaatgggaaatgcagaaaaataaagaggcagttattaaatattatagtgagagcaaaggtggtttcatcctgggagctcatttcacagacacttaactcactcttcattctagacaggttttctgacaaaaagacatcatctgaacagagctcttaagtatgagcagggtcagacaaagataggaaaaatctgttacttatagagcaaacagtggtttcaacagcttggaacctagagggagatcatacttcatcttagacataggcaagagctcagtttcctgagtgagtgtgtttgggtaggaataacacaaagttgatgaattagacaggaataaatcatatttcaagatacagggctattaacgtaaacaggacacagatcacgaagggtctttagagcacccaaaaaagagggtttttgttgtggtggtgttttttttttttgtttgttttttgttttttttttttttttttatcttgagagcatgagagagccactaaaaggctataaacagaggcacacagcatcaaatgtgtccttcagaacgatcaccgtggttgctgtgtggacaagtgattgagggtttgggggaagagggtggctggtctaaaggtaaagggactaattaagaggctgtttcagaaattcagggacagatgatttaggaatgtggcaaactgactggagagacttgaatggatgtgacagatacagacgtgatgaaatctatagatattgaaaaccaatgaaccactagggctggagaggaaaagagtacaagatgatattcaagttttcagaaaaaaaaataccatttctagttgaaaattaagaggttatttgcaaaactaattacagtataaaagactaacaaagtgtgcaaagctctgaaacaagaaggaaacagaacatgcacgttgcaacttagaattttctggtagaggcaacttaaccttcccagagtattcatctccacgtttggggcatccagccattgccaaggaagggcggaaaaaaaagaattgagaatatgtgccatgtgagtgtttgttcatgaccatttaaaatcagatgcttctgcagtgtagacccttcctacgtcccttgtcttagaatggtgaattttccaggtaggcatataccatcgattccagcaggtgctaagcagaaggatctgcagctaacatgcaaatgattagcaaaaaatttggctaattctcagtaccactgccaactccagaccaaaaccaccatcctctccttcatgactcctctaataagtcgtctcagccgctgcccttgtctccccatattctattctacagaaaaaaaagatagagtaatattttaaagcatagatcaagtcatgtgactcctctgctcaaaaccttccaatagatcttactaaaaaaagaaaaaaaaaagacacggtggctcacgcctgtaatcccaacattttgggaggccgaggcaggcagatcacatgaggtcaggagttcgagaccagcctggccaacatggtggaaccctgtctctactaaaaatacaaaaattagccaggtgtggtggtgcatgcctgtaatcccagctactagggaggctgaggcaggagaatgacttgaacccgggaggtggaggttgcagtgagccaagatcgcgctgttgcactccagcctgtgcaaaaagaacataacttcgtctcaaagaagaaaaaaaaaaagataaaatcccatttaaaatggggtatgtgccttttatgataactctttgattttttgtctcactacacaccccttactcactccagctacagcggtctccactatgtgccttgatcatacagacatgcttctatctcagggatattgcacttgcagtttcctcttcctagaccttagtaagtacagcagctaccttctctcaaattacatgcttccactcccaattcttcctcacctcttccaaacccttttatactttttagcaattaccactatcatataaactacatattgtttttatttatcttgtttttcccactaggctctaaacactattaggcagaatttttaccagctttattcatgattcccagcactgagaacagatttgacatgtagtaggaggttgataatgagttaatgaatgttgctgaaatatctaccgaaagcaacaaacatttaccttcatgaatacacatggtttccccttaattaacatacatagatacaatacatcacccttaaatattttgtattgttatgttaatagagaaaaaagttcaatttccccttgggagaaaacactatgaaattgcttaattgcttatgaagaaactgaaaatgtaataagtaactaaagttctaaaaaaatttgagtgaccacaaaacccctttaacctgccctccaagtgggtcctgaaatggaaagctcttaatgtttatttgggtgataagatggatttggccagttcattttggatttgaactgggcgaggctgaattgccctgcctaatagaggaaggtgggatttgaagtggcctacctcctcctgtttcctgggtggagctgacttggttctgtggatgaaaaaagggatgaaaatgaagaaacaggaaccagagaatgcactctccttaagcaatgacaacagtaatttattgagtgcctactctgttaaagatacggtagcagagtcctcacatatattatcccacttaactgtcacaaggactctgttaggtgtatattatctgcacttagcagataaggaaattgagagaagttcaaagtgctttcgtttttgcacacaatttattggtgctgggattgaatctaatctgactgctgtaagaccctctttctccaccaaatgacgtttatttgttcttggaacctctcgttccttctcaccacaaagtagaaggcatttttcttcagaaataactttaggaataataattttgtttccagtaagttcattaaaaccctttgtaacttataatacagttgaaaggccaacattgtttctaggaaatgtgagctgggagctttaaactgcagacttaacaagtcaactttgttatagtctgtttccctcttcttagaggagataaataggcagcactgttcaattactcaaactcattctgtgtttcatctttccagatagcatttagccttgctttattttttcccaccattgaagtacaaaagctgcctggtttttcactgcacaaagtaaatgatgagcccggagccaatttctcatctcagacactgcagttttcaatgtgcattctgaaagctttgaatatgactataaacacatcaaccaaaacaaactgtaatttttataaaataagcctcagagtatgttttgctgaaacttaacaccttttgtctaagggaaaaagcagaaaaggcagtaagagcagaatactcgtactccattcactggcagtgctgaatcccatgtaaaatctggtagtgcataatcaagacatatggcctcatctttctttgccacttcccaggagtgaggtgtttaagaaaactgagaactcttcctggccaattcagaacggggttgtctgcagcaatgctgttcgaagtgtggcatcagcaatacgtgggagagtgttaaaaatgcaaattctcgggcccaccccagacctactcaatcagaatctctggggtgggtgcagcaatctgttttacaagtactctggatgattgcgatgcaagctcaagtttgggaagtataaactaaagggaaggaattccacctgaacgcagaacaatgggattcaagtcactggaacatcaattgacagagaattattctgagataagtcctttaacctctctggcttctgtgtttcttatctttaaataaagaaattgaaacattttaaccctggatcacatcttaacctattatcagagcatatcatggttacctgacactggtataaacatccctcacataatgaaagatttgagtatcattttctgactgctcttattttttctagctagcatcataatgacaatcacagcaacaacatcatgggagggcctcctgtgttcgtgtaccatttcccaagtttaacacgtttgatctgctgatgtcctctagtagtaatatctccagtttaggactgaggaaacagagcttatgtcacttcctgaaggtcacaaagaaagtaaattacagggctgaaatttgaacccacatctgatttcaaaatctgctcctccctttctaccaacgtctatcttcccggaactggtaactttcattaatgagaggaagaaaacaaaacaaaacaacacaatccataaggtggggctaagcagacctcatttctgtgaacagtgtgattccttgaagtatgtaaggcaattactttgaatacatttaacacacgtattgatttcatataaaagccactttacctaagagtgatcaataaacaacaaagcttacttgtagttgtactaaactgctgatttattgacaactctgagatattttgtccctggtgaaaagacacaaaaaatagaaactggagagaactttggaaagcttctgccttaaagaggttaccataggcaaaaggaaatttagaactagagaagcctagcaatttatttaaggtcacatggctggttagtggcagaaatatggttggaatgtatcttactgcccacctgagttggggttattgctgatattattttattaagtgaaactggatattgtttcagaggaagcttataaagaagtgtggtagtgcagattcttcaatgataagccagaattactcacaccaataaagttaagatgctaattctgggcagaggcaacagcctaaagcaaaggtatggggggtctggaatcgcatgatgtgtttggggaacgattagaaattccatattactaaaaaatgaaaaagtacaaaccaggaagcagttggaaatgagcctgagaggtatggagtattgaggttatgaaggactgaatatgtcatcccaaggcatttgatgttcataaggggttgctaaagaattggtgcaggagaatggcatgaatagatttgtattttagcttgctttggctatagtatggatttaaggggtgaggaaaggaggaagatacagcatccaagactaaaaaagtgagatgagttgggcttataatattccaggcagcaaatggtaaagtctgtgcaatgtcaattttacaagcaatgaagtagaagaggaagactcaaaagattttttgagaggtaaaataaccacaactcagtgctcgattcaatgagaaaggagagagtatatgggcgactcccaaatttctaacttggacaactgatgaatggtgatgacatagggagaccaaagaggaatacattgggccaagtggaaatagtaaaactagtattgagttcactgtatccctgcaccatcgctgtcaagatatcctggagagacagtccacacagaggtgatggtccataccattgcaatgtgtgagactccccaaggcaaaagagtaacacagtcaaggtgagagtcttggagaatgttacagaagaggaggagcctacaacaattactgtgggagagaacaaaggagttggaagcagagagggaaagccttgtgtcaaaagccaaaaataattttctttttcacacttcatgaattataattagcttcaaattcatagagttccacggaagtcaaaagtgacttcatttttgcaatatgggtgtcactggtacagaagatcagtaaggatggaaatgcaatcacatggagacgttagctgcagaattgaaacaggtgtgtttctgttttacgggattcaaaaatgctaaaggggagaggacaggacataggaacaaagtggtgcaagcatgacatataaacatattgaggagcaagcagagaggaagaagtgaatgtagggagagaggagacaagtgatagaacatctctgaatgtggagggaccaataaggtgttatttggctttggcttagaaaaactgagactcatgtgaatagcaaaagtatagaccttttcatataaaatattgtactattacgggagttaatgcttatatgacaggccagaggttccttgtaaaaacaaacaaacaaacaaacaaaaacccaataaaaacaggggttcccagattataatgttagctgcagatcagatgtttggaaaggccacgagtttcccctgacatccacctggtcacatggagtggctcagtacacaggcagagctggccacgtgttttccctgctttggtaagccagttacctgcttctcaaataatcaggagaatataatctttggcagtgtgggtatcatgcagataaaactaacaagtaatcattggggccttctcactttttcccacttattgaagttttttctgaataaataccaaaaagcctaatcatagaaagctttaattggctcaattctaattaatatacagatgattaagataatttatatttcatatttatttattacgtgaacttccttaaaacacagtatctatctaccatttttttttctacatataacctgcctgagaactcagaccaaatgagttcccaaattatgctggacagtaggacaagtttgatgaatttcaccataaatatggtttggcacaactttatttgaaaatagaattatagaatttaagaggcctcatatccggaatgcttatatagtttgaatgcagagtgactttggttatagtgaaggaggaaggacaggccctcagttaggtgtctcaaataccttcttatttaattacagcagcatctctaccagagagtattacgcaattatttttatcctaaaacatactctttcccctgacatttgcattttttctgaaatttgcatgcaaactttggttgatctactcattaaaaataatgtttattcttcgcacctcatgcccttaaaagtatttatgtcaataggagagcaatagagagccttaaaatggaggcgattgaagcacagagagactacgcatctcaacaaggtacacaaaccagaattagtagagccagaatttgaactcacgtctatctaacttgaaagctggttaagagcaaatctttgctatgtagatgaaggcactatgctgggtcctgataaggcagcacctgcccttaagaaacctgcatgcagaggaggaaatggacactaaagaataaacaagtagataagagaaatttagatgctccataaattctacaaaggaaataaaacagggtaaggtaatagaggcagattggggagttgcttcttgctgtcctcttccaagaggtaacttttgaatttcttcccattcttgtaaaattgggcaacagcacataccatgtaaaagaagaggacttgcataagccgtaagatagaaagaaacttgcttttgaccaactgtaaatcagacattgccactcctcattgtaagctctaggtgtctctttttaagggaccataatctactggggaaaacagataagccaaattatatatgatgttgttatacatcaagagctataatggagatgtgttcaagattctacagaagcatggaagaatggaaatttgctgtcggtagaatgagtgtttcagaagtaaagatgggagttaagttggtcttgaagaaataggattttgcccaggacatggggcagggaatgggtaagtgcatgccgtgcctgggagatgtgtctgtgtcatgtaacacagcatggaagtctgatgaaggatggcattggcagttgtattgtcatggcggacctaacttggggtgcagaatggggcatgacaggggatgttctgaacaagatgtagcacctggaaataattaagcttggcaaggtctcacaataaattctctctgttcttgaggacaaatgtcactgaaaatacttcaagtgaatttcctggcagtgcctggctgactttccaaggtctcttgctgaataatgtagagggaacactgtttgagtcagtggttctcagtagaatcaccagtagaacttaaaataatatgaacacaaatttaaaactttaaaaaaatacccttgaataattaaaatcagcaggtctgggaatggggattgcacattggtgatttttaaagatcttcaagtgaatgtaatagtcatccagcgttgaaaggcactatttctagaagacttggaagggaaactgagttttcctgaaggcctgagacaccgtatatggcggaacctgtacagaaagaagtcatccaagaaaagacaaggaactgacagggactgatcttaggactggcagtgtccatgttccagggtttagaaaaactcattttttaaactgttgtgtttacatagtagatgtatatatttatggagtatatgggatatttagatagactattgtcaccctgtcatgctttcaaaaactagatcttattcattctttccaagtttttttgtacccattaaaccatcttctctactctgcccccgacccacccagcaacttcccttcccagcctctggtagccatctttttactttagagaaagtcattctgaaagcaaagcaagtgaaagaaatgtaatctttaggcaaccaagctctgaagtctaatggtgagatccgaatttaatggcgctctgaatactcctcagtaattatctcagaagaaaacaatggcgccaaagggaagccctgattttgaacagtcccaggtgacagtaaatgagaagtaatctgactaagaaaccaacggagagtcatcccttgactttcttttccataatgacacctgaagcacacttgtttattctgtaaactttagttaaacaaatttaccctccaagacactgggggtttgccagagaacagttagtttaattggagctcatctgtttttgttcctaatgagcctcccatttcatagcctgctcctagtttgaaataaaatgtcccccctgtctgggatgattaaaaacctggttaagcatacaatatacagtagctgccaaaatgtttccaccaggcaatactgctcagaactgagacctgcaggcaggattagaagagagaaatctgttgattttttccagctcaaaaacaaacaagcaaagaaatcacatccaattatctgagttatattttattaaagaatccaccggagaactgcattcacttctcaagatttgctaccaaaccgtctccccattctgtcttttaaacactcctccaccctttttgttctctagttggtttgtaatttagaaagtgtgataaacaattttggggagccattaagttttaccagtgtttctgtctgaaattaggctactatgtttgccaaagagctgctctgtgctataaaatctttattaaaaatacaattatttacaaaattattaatacttatggattagaataaatgtgacttcatcttgcagctatgggcattttctttttgtttttgtttttgtttttttttgagacggagtctcgctctgtcgcccaggttggagtgcagtggtgcgatctcggctcactgcaagctccgcctcccgggttcacgccattctcctgcctcagcctcccaagtagctgggactgcaggcgcccgccaccacgcccggctaatttttttgcatttttagtagagacggggtttcaccgtgttatctaggatggtctcgatctcctgatctggtgatccgcccgcctcggcctcccagagtgctaggattacagacgtgagccaccgcgcccagccgggattttctttttaagaaactgtaaggtgctaatcattgggtatttcattaggagacacatttaaaaaatctgattctccaagcactttgttcttagactcccacatccctttcaccctcccccaaattcaggatcacaggatttcttctgtctgccttatgtattttgcaagctaactattgcactagaaaaaaaatatctttcacaaataatacagaggcagatgttttctggatcataatgatcaaatagagtgagctaaattgctcattgatctgtgattccttgtcatttgaaaatccgattaaaagtgtagaacttttagaaaagacaaatatacacacactattacatacatcataacactaagcgtgaggagtgggattcatgttatgaatacatagcatttgttctgggaatagcaaaaggttgatactcaatacatacttatccaatgaataaatgagtgaataaaatttcaggatggatttggatggctttgcaagtgagtgtcaataaaccctgggttcagagcctccattatgaacgaaataattatgaaattgaattctcctgatttcttttggccttaaagactttctttcctttactgtgttaagggttgaccatctccttcctttccaaacaattaaaatgtatggagggcatatatgtttgattaggttttcatgtagagaattacagttacttccagcctgtctcatgatttccttgatgggatatttggttgttcctaaactcctctgtagtgcatttaattactatctcatagttttcctaccacatgtctaatgtaatgcattttattcttacagcttcattctcaaaagacatcatttatccctttatttccaagttcctagggcattttagtacatgtcttgacaaaggacatatcccttctctgctgctggaatgggctgccgcctctgagctgcttcaggcacgcattctgaaaagacgttcacacagggaaaaattccgttcaccttccttctcattcaaccgtcctgattttgtctgtgccattttaaaagacttgtgtgcctactttctttgtcagctacatctgccataacaaaataccaaagactgggtggcttaaacaacaggtatttctcacagttctggagattggcaagtccacaatgaagatgatggccagtttagtccctggtgagggccccactctcatgacctaacccaaccctaattacttcccaaaggactcttcttcaaataccctcatactcgaggttaggacttcaacagtaggtcacacacttactgctaattaaggatgtctctgaaagctgtagggggtcacagatgtcactaacaccaaacaatgaaaaagcacaaggcgtcttctttgattcgttgttataggaacatgtccacacttccctccctccccttcgccagtcactgaaagaatacaggatgtgactataaagtgatgtctccaatttttaacatttaaaatagaaaagaaattgtacatttaaagaaaatatggtgccttttcaagaagtcccttggggaaccacactcttagtctaatgacgcttctgaatggcagagcacctttttttaattccccaaagaaaatgcctgcagactttgtggcgtgttctttcgaacgtccgctgccaggaaaatccctgacctttatgcgatgaatttgattttgggaaatagcaaaattgcctttggagacaagttttgcaatcaagttaagtgatcacaccagagaattctgcttcaggaacaaaactgggacagataatagactaataagatgccttcaccaccaggcttgtaaaacttgtcttgagaccaattacaatatagaccttttcaaacttatttttagcaataagagcatagtatggttagtgtgtaaattaaggtaaaaatattgaaacacaagatatatttgaaagcctaagtaatcctattttttagtttaacctttccaagactgtctttgcacacttggatttttatttgaaaataacaccaatttgaaattcatactaattgatgctaccacttcaagagttcatgaaaccaagcagtttcaagtgaatttgcgttggatcaccctgtcctgagagttaccttttggaaaacataacctgcacatatgtctcatttattctactcaatgcctcccgatgaaatcagtagcaacaatatatgcatagtagcgaaataattgggcaaaagatgaatcataattttgattgtaattgggggcagtgagagaggaggaggaaaatacagtcattaaaaacatatataagtaattggcttctttgctttcttgtgaaatatgctagccccacaacatgattcttactcattaactttagaagtgctgtttctaccgtattcacttcctagtggcattgcaggagatccgtttgcaatttgtgtgactgactcaagatttcatacaactcttgtttctgaaatgtcttctgatcactgagtcataagagtaacacttctcaagttgttattgttctgaaagtctttgaagggtctgggatacttggacaatattatttccatcggtacttttccatcctcctgtgtatggtattatttccagccaactttggaaaaatagcatttcaacagctttgcatatccacattgcacctgcttctggactataaatgattacgtataatttaaatttatagaaaatgttcacaggaaccagatcacagggcacatatgtgactactgattgcttctatttcttattttccaagtataaaaacatatttataatgaaaagcttatacttgctttatctccaaatcaacaaaaattaaacctctttgatattagccagatagactactctttcaactttgaccttaaaggacaataatgaatctcattaaaatcatatttccaaagtggctttcagaaagtctcctactcttacactatccccaggttcaacaagtttatttttggatgcacttaatgctttcgtttcttcttttcagattctgatttaatcacttagcttctgtggcataatcaagacaagttggatgaattgtctcctaactggattataatgaaagaagctctaactggtcttaacgtagtttcgatgtttggagtctttcacaaagagaaacaaaagcatgataagaatgtgctaagctaattcgaaagggaagcaagggtgtcacaattaaacaagggtgtccaattatattgttcccatacatcattccaccactccaataggacatgggcttatagagaacagagtcaagccttgtggttcctgttgtgcccagcacacacagcattgtgcttggtatatagtaggtgctcaataaacatttgaatataatttaatctaggctctcccagggagaaaatatagtttagggttcaaggtaaagaatctcaacatggccagcacagtggcttatgcctgtaatcccagcgctttaggaggccaaagcaagaggatcgcttgagtccaggagttcaagaccagcctgggcagcataatgagtccacatcttcacaaaaataaaaataaaaaaataaactggatgtggtggcgtgcatctgtagtcccaattaatcagattgcttgagcctaggaggtcaaagtttcagtaagcagtgatcatgccactgcactccagcctgggtgacagagtaagaccttggctcgaatcaaagcaaaacaaaacaaaacaaaaacctccaaaacatttaaacattagattctccagatatatgtatgttttgtatatcgatcattctatgccacaggaaatgttcaaccaggatctgggtaaccagattagtgtcacaaagaaggagtttgtagatcacctaggaagtagaactaagttatatctaagcaaccttacaaattgaaaatctatcagtctttgaaaacatatctgttctatgtttctcacagtcttattggtgatgggataatgaccagttggccatgatcttaacaggaaacgacaatgtaatatgctagcccttctaggtaacatatttaccctggcacagaatgccttaattccaaggtgtgactcactgtaatcctgagaattacagtaatttgggggtggaatattatggccaaaggcaatgagcacagaggaaacttctcactgcgaagctgagaatgaactgaaatgatcaaaaattgaatgcttgaagtcttttaataaattataggtagaaggtaaactcagctatttctggacagcaggaaagggtctaaacagaggaggtagcacagacgcagcaatggaatgtgaatgagtcatatttccacatcagtagggctatgaggagaccactctgagatgatatgacagatagtggctgcattcttcagccctaggaaaaatgaagattgcaggaattaggttaggaggtgaagactttcagggaggtagagtgggaaccagaggccagggagagtgttgtcaagtatgctgaccacacagtgaacacagaggatacagcttgatgctcctgaagtcattacaggcagggttaaattcccctcagtgacccactgacccccagacaccaggcatggggtcgaccagctctctccagttcttctccaccactacataagagaagaagccttgaaaatgccaccaagcttttgggctcagaatgaatcatgatggaagctactgcagccttgacactggaaggcatttcagttctgtcaactcttgcctcaaaggaatgttcatttccttttacacaagataaagcttctttgaggaggatttgtgtcaggtaaagaggaacactgaataaactgttgtggtggatgtcagtgtctattctgtgcctgaaattggaatttgggcttagaacttaaatacaggatgtgactcaatgaacagagaccagagttccagtacaagatataaagagactttgttttgaatcagttctagtatttctagaaattcttgttatatttgatggagtgaaatcggtaattctttgaaactctttaccttgtcagcttccatagtactctgctgtcctcattatccctttacttctctgagccttcacagaatccttcttatcttcccaacttacataaatgttgatgttccccaggaatccattctcagacctcactttctctatatgagctcatccatgctgcttcctccaatcatcaaccatattctgatgacatctacatctttacctccagttcagactttggatctttaaaatcatataattgcttctaccttctaggtctgactatctcacagataagcaaatgcaacatgatcaggatttatcttcacatccaagaggtccttctactacaagaccaccacatgccccatgaaagtcatactaaaaacttaggaggtgtcttgaattctcctttcccctcaaagcccatcatatctactctgtcaagtccttttcacattcccccaacactattcatggatgagtctcatcttctccatctctggaatcacctcgccttaaaggaaacatccaaatttatttttaaaatggaaatgtacccctatgcctgaatcacaggaaagcaataataataactgattaatatttctgcatcacttaaagaataacattcaaaatcacatgtcttttattatggaaatgcaaatcaaatcacattgagatattatgcaatacctcttaggaaagctgatatcaaaaattggaaagcatgaagtgttggcaaggatgcgtggatatgggaacatgagtgcatggctggttgaaatgtaaagtggtgcaactgctgaggaaaatggtatggtagggcctcaaacagttaaacgtagcattaccattgactcagcaattctacctttacgtgtgtgcccaaagaattaaaagcaaggattcagatatttgcacagcattgttcatagtagcattattcacaatagcccaaacgtggaaacaacgccaatgtccattgatggatgaagggataaacaaaatatggcataatatacatacaatggaatattatttagccttaaaaaggaatgaaattctgacatatgctatggcattgatgaaccttgaaaacattatgctaagtgaaataagccagacacaaaaggacgaatgttgttattagtttttctcagattacacatatttgaaatatcttagaagaagcaaattcatagaaatagaaggtaggatagtggtgataaggaactctgcggagagaagaatagagaatcagtgtttaatgggtagagcttcagtttgagatgataaaaatattctggggatggatagaagtgactgttgcacaacactgtgaatgtaattaatgccactgaactgaacacttaaaatggacaaaatgctagaaatatatatattatatatattataaaaatggagagacagagagagaggtagagagagcagatgagaaacaatgatactctatttttttcttctcacaattccttataactaatattggttatatatataaccactattctatatatcatggttatatataatatatatattatatcatataatatataaccatataatatatattatatataacacattatagatagcacagatgcagctatatataatatataatatattatattattataattaatataatatagtatattgtattaatataatataatatagtatattgtattaatataatataatatagtatattgtattaatataatataatatagtatattgtattaatataatataatatagtatattgcattaatataatataatatattaattatatatatttttatttctagatatatattatataatatgatatataaatatatacaatatacatttataaatatataaatatatataaatatatactatatataccatatataaaatatatacaatatatacaatatataaaatatatacaatatataaaaatatataaatatatacaatatatacaatataatatgtttaatatataaatatatataaatttttttttatatattaaaaaagagagaaagcttacggcatgtcaggtactatgcttaaaaaataaaagagtatataaatatatatatttatatatatctagaaagaaaaaaaacaaattgaaattacatgccatctcctacttcacacctcgggctccagcagctctatcgtcacctatgtaatcttcatttgcacgatacaccctgtccatatgaattgacagctgactgccactctaggacccttttctgcctccttacaaactggatgagggcttaggtcgctgacaatattccaaatatacccttttattttttaagcatggtacctggcatgctgtaagctttatttcttttctttttttcttttttcttttttttttttgagacggagtctagctctgtggcctatgctggaatgcagtggcccaatctcagcacactgcaagctctgcctcccgggttcacgccattctcctgcctcatcctgagtagctgggactacaggtgcccgccaccacgccctgctaattttttgtatttttagtagagatagggtttcaccgtgttagcctggatggtctcgatctcctgacctcgtgatctgcccgcctcggcctcccaaagtgctgggattacaggcgtgagacacctcacccagccaagctttcttttatttttatttttatttttttcggatggagtctcactcacacggttgcctaggctggagtgcagtggttcaatctcagctcactgcaacctccgccttctgggttcaagcaattctcctgcctcagcctccagtagctgggattaaaggtgtgagctaccatacccggttaacatgcagtaggctttcagcaaacactgagggaataagctcatgagaagcagctatttttacaaatgtaaaatattaaaattggaaggaatcttaaagtttagtctaaattcttaagaaaagtgctattttgacatggtagacaaaatggtgccttccagaggcctaatttccattttaaattaaatagcagcccccttttttcttttccttttgccaattgattctaccattttatgaactcatagaagggttagatctgaatcacacaattcattatgtcaagtgttttccaaacttcaagaaatcttatcacatcttcatagtgcttgctctacccatggactagctgttcaaatgttcaaataagttcatcttcatccaaagcaatactgtcaataaaatataaattattttatcttattttaagttccaggatacatgtgcaggatatgcaggtttgttacataggtaaatgtgtgccttagtggcttgctgcacctatcaacccatcacctgggtattaagtcccacatgcattagctatttatcctgatgctctcccttctcccaaccccctgacaggctctagtgtgtgttgttctcctcaatgtgtccatgtgttctcatcaatcagctctcacttataagtgagaacatgcagtgtttggttttctgttcctctgttagtttgctgcggataatggcttccaattccatccatgtccctgcaaataacatgatctcattcctttttatggcagcatagtattccatggtgtgtctgtaccacattttctttatccagtctatcatcgatgggcatttggcttgattccatgtctttgctatcgtcaatagtgctgcaaggaacatatgtgtgcatgtatctttataatagaatgatttatattcctttgggtatatacccagtaataggattgctgggccaaatcgtatttccagttctaggtctttgaagaatggccacactgtcttctatgatggttgaactaatttatatgtccaccaacagtgtaaaagtgttcctgtttctccacagtctcatcaacatctgttgcttcttgactttttaataatcgccactctgactggcatgagatggtatctcattgtggttttgatttgcatttctccaatgatcagtgcaaatcacagttttgatgtggtgtttatatatttttagtacattaaaataaataattaactagtacaataaaaactcacggatgtaccacctaatgtcattttcttgtactacatggtatgtaaatcatgctttgaaaaatcaatttgaatgcatgattgactactttcttgaattatcctccagggtcctgcatagacaactctgattcctcaacaagctttcacactctctaaaagcaactctctaaactctctcttttctttgttgtcatcgttttatgtttcttagctccttgacgtttgtcaagctctcaccgtattcaacaagtatctgttgaatagatatacttgctgcttctgagatggtatatattatcttcccttataaagtgaaagctatttcataaggttataaaattggaaggtgagatgtccatgagattgcaccttgcaaacattcaagtacaaggaggcaattgaatctgggtcgtggctcctgtactcctgaatgtttgcactaaggccacacctcccacagactctttcaaccaatgactgaacctgtagaggatgcgatggaaggcttctctctaggcaacatggaactcctctcatagccaactttggtttcagaactccctgaaagattgctgaacctattgacactgcacggtggtctagatcacttccaccaacttcccttccccctctccttcacttagggtcagacttgcatcataatttgattgattgttctcccactctttctctcctcatttttttggagggattttttcttaataaagtccctgtatatatagcgctgacatgcttcttgggatacttggactaacatagaaagtattagtgagaactacataaatgttagagatatttcaagctgaatttgtctatgagagtttggatagggttaattctgaattcagacagtgttgagttaaatttctgaattacttagttgtattagtttactagggttgccataacaaaataccacacatcgggtggcttaaaccacagaagtgtattttctcactcttctagcagctaaaaatctgagtttaataagtgtccccagggttgatttattctgagggcttcctccttggcttacagattatgatcttcaccctgtgtctacacattgtcttccctctgtgtgtatctctgtccatattttctattcttttttgttgttgttgttgttgagacggagtcttgctctgttgcccatgctggagtgcagtggcgtgatcttggctcaatgcaacctccacctccctggttcaagcaattcccctgtctcaacttcctgagtagctgggattacaggcgcatgccaccacgtccggctaatttttttgtatttttagtaaagacggggtttcaccacgttggctagactagtcttgaactcctaacctcaggtaatctgcctgactctgcctcgcaaagtgctgggattacaggcgtgagccaccgcgcccagccaataacctcatattaacggaactacctctttaaagaccccatcttcaaatacagacacattctgagttactgggagtgaggacttcaacatttgacttttagaggaacacaatttagcccatagcaccacctgaataactttgagccagtcacttgactttacagagccttagtctgtaaaataggggacaatatctaccatattattttgttcaaatcaaatacagtgacatatataatgccactggaacatataaggcaatcgtcattaaaaaaaatcctcccaatttactaaaatcattgccattactttattagaattaatttatataggggttctattattcgcagtatgtctcacagctatataaagtagcattatatgataaggttgaaaaggaagaggaaagaagtatacagtgtctgattgcatagcttcatgtttatgatatgacagttctatgattctgagcctggcatatttatttaagctatacaccagagttcagaaattgatagttaagaggcacatttggcctgaaaatgtctgtgattttccagagagtattttaaaaatcagaatagaaatgcctttaaataaagcatgcttctgctgttttccacagtttttcatatccctaacacatggtcacattatacaggtataatacttatctagcccttaaaagcttttaaatggacaatctttgaagcacagaccacaggttcagaatgtactgcttctatgtccttgactattctcaaaagaacatattttctaccatattatctaaattatctgagaaagacacaggtgctgctacattgttatcctctagggatgctcacgtttcttcaatatccacaaattcctcctacaatcatctaaggctgctccccattccaccagtaaatattaatcaacaaagtaacaaatagtgcgatgtgccaagcatctttagcgatatgcaccctcaacttcaaacagaaactatttgggatgatactccctcttctgcctgtagataggtaaacaccctctgcaccctagatttaccaaacttcatgacgtacccaccctaaaaggacacgatcttcagggtacacagagtttttctctagatgcttgacgatatcgccattcttcggctatatgagcttgctttttaaaaacaattacttcaggaatctggtatccagaagaaaatagggtagttttcaaactttcattgcattatttttcatgatcaagattataaggtaaattggaactattatcatgattcactcttccagatggttatgcaaagattgagtgaatgaatagagacaattttaaagaaatgaataaaataacttgtatggttaagtagcaaagccaaggagaagttgggaggaagagttcccaaattgccttcctgagactagacaatttgagtaggtcaagaatgagaatctctacagaaacttgctaagacttttaaatgcagtcatgctttgcttaaggatgaggatgcattctgagaaatgtgtccttaggggattctgttgttgtgtgaagatcacggagtgtacttccgcaaacctagaaggcataaccgactacacacctacacgatgtgatatggcttattgctcctaggctgcaaacctgtacagcatgttactgtattgaatactataggcaactgtgacacaattttaagtatttgtgtattttaacatacctgaacatagaagaagtacagtacaaatactatctaaaagtccaaaaataatacacctgtatagcacatttactgtgaatggagcttgtaggactggaagttgctttgagtgagtcattaagtgagtggtcagtgaatattactttataaacattgaagactttataataaacattgtacacagaggttaccctaaatttaacttaaaatttctttgttcaataataaattagcttacttgcaactttgttactttttaattttttaaaagcattttgactcttgtaataacacttagcttaaaacataaacacattgtatagttgtacaaaaatgttttctttctttatattcttattctataaaattttttctattaattattttactttaaaaagaaatttttgttaaaggctaagacacaaacacaacattagcctagacctatacatggccaggatcatcaatatcactgtcttccacctccacatcttgtcctgctggaaggtctttaggggcaataacacctgtggagctgtcgtattctatgatgacaatgccttcttctggaagacctcctgaagggcctccctgaggctattttacagttacctcccttttgaaaaaataagtagaaggtgtatgctctaaaataataatgaaaagtatagtatcgtatagtatagtatagtatagtatagtatagtatagtatagtatagtatagtacataaaccagtaataaagtcatgtattatcattagcaaatattatgtattgtgcataatggtgtgtgctatgctttgatcagactggcagcacagtaggtttttttacaccaacatcaccaaaaacactgagttatgatgttatggcggctacaatttcatatgtgatagtaatatttcagctccattaaaaccttgagaccaccattgtattttcagttcattgttgacccaagcattgttatgcagcaagtaagtgtgtatttaagctgcttaaattaatttcaattgctgttccaattttcttagtcattccacattttgttatgacactcctgaccatagaagaatgcagcaaaacctcacaattcataaaatcacatcagctgtgcacacagatgatgtacatttattctgtgtaagcatcttaaaaacaaactcaaacccattcttttttccattgcataacctttaagcacaatccaaacatttcatttgatgctattaaaaagatctgccgatgcaaaaccatattatagccaggggtggcgggttaatacttcaagtattttcaagataacttttactgttttggctatatacaaggtggtgcctttgcactgattttgtcaccccttagcatgagatgaaaatccacaggaatttaaatctagaattagaacatatgagcaagaaaatttgatttctttctgatgcatgccagaaatagtatattaacaataatacaataaaggaaattcaaaaagtattcatctaatccttactaaagttattatcaatgagttctaaactttattttgtcctttaagaatcacaaattatttgtttcaaatgatcctaatcatcatctaatgtgtcttatactgctatcctataagtttttttgtttttgtatttgtttttgttctttggagatggagtcttgctttttcgcccagtctggagtgcagtggtgtgatctcggctcactgcaacctccacctcccagattcaagcaattccgcctcagcctcctgagtacctgggattacaggcacacaccaccatgcctggctaatttttgtatttttagtagagacagggtttcaccatgttggtcaggctggtctcgaagtcttgactttaggtgatccaccctccttggcctcccaaagtgctgggataagtttttatcccataattaccccataaaatttgaataagaaaatgaatgcctcaggaaaggcaatataaaacaatgaagacattaactagtagtcattataaatatagttaaagacctaaatgaaatcatgcttatagaaatagagaaagccatgacaacaacgtttcagcaaagagagaatatcaataaagatatagacattattttaaaaagaaccatctggaaatgcttgaattgaaaaatataataaccaaaataaaaaattcactagcagaaagtgaaaagacaacccacaaaatggggaaaaatttttgtaaatcatttatctgacataggacttttatccaaaatatataaagaatttctacagcttaataatcaaaagaaagatcactcaattgaaaaattaagaaaggatctgaatataaatttcttccaaaagtatgcaaatgaccaatatgcacctaaaaagatgctcaacatatttaaaccattaggaaaatgaaaatcaaactcacaatgagggccaagcacagtggctcatacctgtgatcctagtgctttgggaggcccaggcaggaggattacttgaggccaggaatttgagaccctatctctacaaaaaaattaaaaagttaaccaggcatggtggtgcacgcctgtaggtctagctactcaggaggttaaggtaggaggatcacttgaacccaggagtttgaggttgcagtgagttatgatcctgccactgcactccagcctgggcaaccgagtgagactctgtctgaaaaaaaacgaaaaaagaaaaatcacaatgagttagcacttcacactcagtaggatgaccataatgagaagcacagaagaacaagtactgggaagcatgcaaagaaattggaaccctcatacactgtgggtgagaagggaaacggctttggaaaaccttctggtaattcccagttaaacaaagagttacccattatctagaaagtaagtgattttatatcatagtttctgctgcacaattttaattcatttattttactgacaaaatttaacaaatttattttagtgataaaattagacaacttaaaataatttgaaaccaagtaaagtaatgctttttcccttgcgacgtcattagctagtacaatgaatttttgagtatcaatcagtagtagccaccactcttgtcaaccagagtcctctctttagccaattctctagttcaaggcaattaatgtttttgaggttgacatgggagtcaggcatgactctgtggttccttccaaaccatcagtgaaatgtttaattatatttagtaccatgttttatgaagtcattttattcttggaattttggcaaaccttgaatcgtacttatagtcattccccaacaactaaaatatctgatttagtcttccagatattagagtttacataaatatttttaaagcttacattttcatatgtatatatttccaatgaaacccctatatgtttgaaccgtttctaaaattgtcattaaacacccagcaataagtctattattctctgtactaatttgctatacttaggctgtgtagaaagttttctttaatggtctcttcaaaatttcaactccgcccgctgacatttagtgaatgtcaagatgcttaatacagggctgtgctttctgcttttttcaatagatcctattgttattgacttatcctgatgagaaaataattctatctcaaatcttagaaaatgtatctttggatcaagtaagtatgttagtttcttaaagtgtccaacccttcatcaaatttttttcattgattaattttacaaattttaagaggaaagggagaagtgatcatcttattttatgtaatatgtttatttgtttaaatatgtagagcttattgaactacattaaaatagaatgaggctgtgagaccacatagaacctgagaggagatttaccagtaggtcaaagaagcttttactttaagaatatcaataatttcccaaggcaagaaaaatgtaagattttacatgctaaagtcatatagtcagcatcatttaaactgccaactgtcacaatttatgatttgtcatttagggtttgtctgacccccatacaggtgaggtaggggaggaagaagagagaaggtaggtccagctcagatgcctgctcaggtggtcagaactcaggagatgaaccatactgagtagctggaagagttaagaaacctgtgtaaggatgggccaattgtcaaagcagttggagccaaattctattcttagtccaagtgtttagcaagtgacttagagagacaaaactgctgccagaagtcaagtgaacaccattatggtgcatgtagtgaaaacaactgagagagagagagagagagagagagagagagagagagagagaactgcaaaaaggtcactcattgatactgttttttttttttttttttttttttttttgagacggagtctcactctgttgcccaggctagagtgcagtggtgcgatttcgcctcactgccagctctgcctcccgggttcacgccattctcctgcctcagcctcctgagtagctgggactacaggcacccaccaccacgcccggctaatttttttgtatttttagaagagatggggtttcaccgtgttagccaggatggtctcgatctcctgaccaggctatctgcctgccttggcctccctaaagtgctgggattacaggcgtgagccactgcacccggcctgatactggtttttaaaatttattttaatgatttaataactatttactgaattctttcagtatgccaggcctagattaggcttcagtgatataaacgtaaacaaaactggcacagtctttgacatcatggaacaccgattctaagagaaagagagaaatattagtctaatggccctgaaaataaaaacaagttacaatcatgaagagtgtaataaaggacaaagttgctgtgataacccataatgaggcaacttgacttctcagggtcccttgccttctggtttctggtcagatttgaccaatgggaggtaccagtaccagaggagacagcagagactgagatctagatattgtttcctctgcctcatgccaattatggctttctagttctcagagaagcctgtacatctccagcagctctggccatattctctttatggttccagctctcgttattatagctcttgttattgttagtatctggatggcttgagattaaagggtccatgggatgtcctgctgctggcagtggctcacacctgtaatcccagcactttgggaggccaagttagtttgctcggttgaacccaggagtttgagaccagctggggcaacaaggtgaaaccccttctcaacaaaaaatataaaaattagccaggtgtggtggcatgtgcctgtgatcccaactactcaggaggctgaggtgggaggattgtttgagcccaggaggcagaggttgcaatgagctgagatcgtgccactgcactccagcctggggggacagagcaagatactgtctcaaaaaataaaaataaataaaaataaaataaaaaaggatccatggtaacatcttcattaatttctttttagaatctgattgggatatagccttctttttcctgcaaggacaatggctgagagtcagttaggtgaaaactgggtaaaggcagactaagaatatgaaacagcatctgaggtggaggtgacaatggccagtcatagtcacgtgagtgtgtctggaacatggaacacaaccagtcttgcatgaggcaggagacctaggcaagagttggatgatgcaaacctatgggtcatttgggggttttgtctctattataaaagcatttctgaaggttttcagtcagacgagaactttatcaggtttcaattttcaaaagattattctgactgtgttgagaaaaacatattggggaatatcaacagtgggtgtggatagatcagtttcttaagagctttttgaacagtttgacatagagctgatgattaattagactaagatgtcggtaatggaggtagactaaaagaaattgaaaggtttaatcggggtcaacaaagtatggcctgtgggttggctgtcattgtaaataaagttttattggcacatggccacacgtatttattatggattgtctatggctacaacagcagagtagagtggttggaacagaagctgtgcggcccgtgaagtcttaaatacttactctcttgggctttaagaaaaacttcgtcacccctgggttaaatcaagagcatttggcattagattagatacggggctgagggaaaaaaagggaggcaggagagtcagggacgaaggagacgaggccacagaagctcttctttgacagtgataatcttattttaggtgcataattttgggatttataatatacagatatataatgtatgttatatatattataaatatatatattatagatacaaaatatgaaaagatatgtaatcttcttgtctttgtcaccaaatcatcccattgctgaataagacttcttctattgttcttttgttttaattgcaaaagtctagttttccctttgaagaaaagaagtagagaaaacattaattcacaagggaaaggaccgtttgtctaattttgttagaaggtctcagggctcagttctcttctcttatttatgtatattcactcttctttgttttttaaaaaaatcttatctaacctcatggctctaaataatttaacatgatgacaattcacagtttatatttctagtctgaacctctaaaattccagacaaataattaattaccttttcaacatcgccacttcgatttctaatagacatctcacaatcactgtgtccttaactgaattcttgacttccccttaagcagatctactcacagttttcccatttcagttgatgaaagtgccatcctttcagtcattcaggccaataccactgggaccctccattaggaactatgttgcctctaccttcagaacatatccagaacctcaccatctctcccctcccccccaattgtcactgtcctgatcagagatgtcatctttcctaggctgaatttctgtaatagcttcctagcacgtctacttgcttctatccttggcctacccactgtagtctattttcaaagaagtagagtgaaccttttaaaatagaagtcagatcttgtcacctctctactcaaaactctccaacagcctctgatttttacttgctcagacaaagtacttaaaactgcacacatgacctcacataatctggcttccatattcctctggcttccaatatgttttattcactcctctaaatcatagagtctccttgaattaacatgttcctgatccaatgtactgtagtaaaggagtgaaaagtaaacatgattcccagaggcagttagtgagatggttgcaggtaaccattgcctcccacactctcttccttccttccatcctggcataggttatttagcaaaatacttagtaccttctaatatgtgttacatgactgctagatgccagtgataggaaaatccatacaacataggaacacacaatctggtggggaaagatgatatggaaaccaaccaatgcaagacaatgcaaaaagtgcaggcatagaatgatgggctgtaatttttaaaaactcaccatgtctaagttgggaaggatagagattctatatgatggatgcaagatcattccaaccaatgtagtttggaagaaacccaaagcattctaaattatctagtgaacttcatgttgctctacctaaagtatttccatagtaaccaggcctgtgctcttgtgtggagcatgagtggctaaccactgaattatattccttttgtcacagtctaagagcaatataaattcctctttttttcaaaatgcttcccaacttgagacacaaacattctaccaagaatagatttgacttaattatctatacgtttaaaatgtaaatgcagcctttctaagagaagcctacatttgttaaatcaatctatgagatcaccttctttctaagatgagggtaacttcaatattgaagtgaagacagtatagagacactaagaaatctacccaaggacacacagctgatcaggggctctgacttaatttttttcccaaacattaggtttcctgagtgcaaagttgttatattcgttcctacctcataagattgctctgagcagtagaagtgataatatctgaaacatgtaggacactttctatgatgtactaacagtgcagtaattgttagtttctccaatgtcccacagccaacctatgctactggctgcaaattctaagttatggactattaaatgatctggtcaaaactggatatggataaaaatgcactttagaattacttttgggaagtagaggttgccaattaggtgggtggaaatgctttctgtcctgtaaagtccaagagttgtctatcaccaacgacaccattggagggaagctgttgagtgcactacctgccatctgggcctctgttgttggacactacttgactctttaaaagaggttgctgtcagcatcatgtctatttgcactggttgttgagcatcattatggaaggtgagtggcccatgttgacctttatgctcctacaccaacttgagagcctttaactgcatagaggcctttgacttaatgtaataaaataatgactctttccatttcaatgtttccattggtgttttacttgaatccctactatacaaaaaaccttagtctcaatagtttgaacagtttcttctatgtccaaaacactcaatattgagttctcttgataaaaacaaaacttggagttatttaaaaaaatagttcagttggagactccctttgctatctaaggcaggggtccccaacccttcggtcatggactggaacctgtcagtggcctgttacaaactgggctacacagtaagaggtgagtagcaggcgagcaagcaaagtttcttctgtatttacagcagctccccatggcttgcattactgcctgagctctgcctcctgtcagataagcagcaccattagattctcttaggagcgtgaaccctattgtgaactgtgcatgcaagggatctcggttgtgtgctccttatgagaatctaatgcctgatgatctgtcaccatctcccattaccctcagatgggactatctagtggcaagaaaacaagctcatggctcctactcattctatattatgtgagttgtataattatttcattatatattactatgtaataatagcagaaataaagtgcacaataaatgtaatgtgcttgaatcatcccaaaaccatccgctgctccccacgtccatggaaaaagtgccttcatgaaattggtctctggtgccaaaaaatgttggggaccactgatctaaggtgtttaacaaactgtttcttacttttaatcaaaccataccacactgattgacttcagaaatgctttgtttaactagaagtgttcaggacttacgcatgttgcttttatcatcatcatcattataacttataacactaataataacaataaattaccagactttgagaaaaatctcagaagctcaatgaagtgtatagttcataatcagtactaaattgataggcttgtggtttagaatttgtgtagcggaacgaggataaatcagacttcagtatgatttgtgtatttgtttactgtagcagaaatatgatgtcctgaccatgtccccttgacccactctggaagccatgaaagatagtctcattcagagctacagctgtccatggctctgcttgagggtgttccccaggcccagagaaacaccttcaaaggagagagcatggcatagaagcaaccctcatccaacaaaagataggaattgtccatttcagggtcaggttccatcttccatctggtctccaagagggtcctcaaaagactacgcctcccatgactatacaaccttccttagctttcctctcttccttgttccccattcccacttcttcacatggctttctggaattacttcccaagttccttgcacctacgtgcttgtcatagagtctggcatgccttaatgaaacactcgttaattttttatttgagatccattgaatcctcactctgtgccagacatctttcatttatgaaatagtagcttctatttttgtacccatttttgtgataaattaatgtttagagagatgttaaataatttacaaatcacagtgagtggcaaaacctagtcaatttccattcttcagttgcttctattgtttgattgctatcttttacctttactccatgaattcagattggtaaaacaaacaagagactaaatgctgttatactgtgacattctgtaaaattcaaatctctgggtgaattttgatctaagggatatagaggtgtgtcttttttgttgttacacatgcaaagaaggcttctctccactgtacaatatccccttggcttggctgtgagctcatctgctctcatttttgacttcagtttcctcaaatggaaaatgaaatgccttgggctaaatgaattttaggatccattgaaaagctaacttcatacaaattcgagttatgtagtctggtccctccggccaactctacatcgctagctttttgttttatgctgaattctcttgataacaacttctaaagcaaagcttttctataaaatgccagatagaaaatattttaggaattttgagctgtaaggtatctgttgtaatttctcaattctgcaatgtaacacaaaagacaatatgtaaatgaatgagtgtggctgtgtcccaatgaaattatttatgtcaacaagcagcaaagccactagacgtgctcaatgttgcacacagagaacagcctcgaagggcctcacaccaagacatggcagatgaggaatgacaggaaaatttcaaacattgcttgtatcctctgtgtaactgtcctcctggaaactttaaagatatcgctcactcacatagcttctcaaagaaacaaaggataaagaaagcttttctatttctttcttacatgagcccggatggcttctacttgacatggactgttttgtgttgtgtttgcgctgggcttagaggctgagaagagtcaatacccaatgggggtgttgtctggagagctggggaatatataaatattgcatttggaatgtactttcctcttgaacaatcaacctttctgcacaagtttgcttgctaagggtctgttattggcatttttcttataacccctctaataccaagccttttcaaagaacatatgactcagagcaaacattcttttgaggttgaatctggcattcttgatgttattcaaggaatatatttctttgtataaacttttcatagaaaacttcctgaacctgttttagagagcccagaaagtcctagaaaaaaaattgctgcctcatgcttaagcttctagtgggttttgtgaactgagaatgcgtaaacatggtcaaacattatttctgatcccgtttgtactgaaaatctctcctgggctggtgatttgtaattaatgatagttcaggaaaccttgacaactatcttagagttggggaaaagtgatacaggctaagcaacgagctcgttgtcattacatgtaatcaagcagaaattgaacagccattcaccaatgatgctgttcagagatttcacatcaggtgagactttaagaaaatagactctgcagagactcacctccctacctgtgagggagaagcaagggaaggagtggaacaaggtctaaggcagattctatactctcccttttctcctctctcctctttgaactggaaaaactcaggtttacttttttagatattagacagttaggaggctttcttaggaagaaagtgttctactactactaataacaaaatgaatgaatgaataaataaataaataaaatttaaaccactggacaactgagatcttgaattatgttaatcttaagattttaaattttctacaagtaggctttgacccattccacataagaactcatccctgtctatcttcctcttagtatctctctgatctccacaaaacaagtatgaactctttttatcctagatacatttaacagctacatttgatagaagagtagaaaattcttcataggttttccatttacaaggaatagccatcaggtttagaattttgaccatcattaataagtaaactcttcaaaagtcaagcagggctatgttttttgagaactcagccctttagggataaaaggaaacctttagtaaatatccatcggtctattgcatcttggccctaggggcatgcatactcttcgtgttatgtcctcacataacttttatagctgattctcttaaagaaggatagagtcagaggagacagtgaaaaccatgaaagtatgaacatggaattcagaaaaggtgacaatattagtatcaaacatatgtcaggtatggtaggtacctgataaaaatttactgaatgaatgattgaggccatgattatagacactctctatataaagtcttctataaaaagaagaattttgaagcaactatcatttaatttaaatattgggccaatatgtattttaatggtaatgttggaaaactatttccagcaacaaactttatagtaataagcaagcattctgcttatatgaaaatcacaaacagtggaagatattgacttgtacttattgtgcaggttctgaagaaaaccgcatatggtctctctggcaaaagctaatgaatttatgttaaaaatatttttctgcgtgtattgcaagtgttatatacacataattacatgataaatataattctatttgattttccaagtaattaatattttaaatatttgcaaaaagggctatagcacacacaaaaaagagagagacattgaaaaatctgttttaagtataaaacctaagcagttggcagaggagaaaagaaagaaattttttacatctcattattaggattcagtgcacacttatagaagagttccttccccctaaaccctagaattctagcagagaacagagccaaagtgaattatatataaccctgaagcttcatcaagagaatcattggtatttgtttacagatcagtattgaaaacaaatcagcctggagggtttagctgtatggaaggatgtagtttgcttcttaaataacccaagctgtgttgaaaatgttctttctggcctccttatgttctttctgttttgtttctcctttcaaatgcagagtgaatatgattggaatggtctttagcttcagccaagatctctaatgccctatgactggggcacccttgtcttttcccctggtcttccttagcatggtagcctgtgatacttcccaaagttgagttctgggtgactggggacagcctgagaaatgatggtcgaatgatggttgaagtgatggtttctgtcagtcaccaatgaaggggcccattaattttcaaggcttagtgtgagttccatctgttatcctaattgtttgtggagattacatgccagggaaaagagttactgaattaattaaaagtaaatgtcgcttcctaaaactcagcccggtaaacacagcttggggaaatatttccttttgcttgaatgacagctcttggagttaggtaacgtggtgctttcagacatggtttacacctgcagaaacgtacattgctggacagctgtcctgccccctagggtatggatcactgacagttctttcttactgtcaattttgcagagcccagaggcagatgcctacgtgacagcactttaccatccagcatgattgataagacaacccaataaggatccaaagcaatttccttctcttatccttgcctctcaactacatttgcttttaatggacatgagtccaggctggcagttgtggaaagattctgggatgcaatgttttgggggagagcaccaagcttcatttctgatctaaattgctagttggttcttattttaatcttaaatacactgaagaacagttgcctttgatgattttgtcagaactgctagtttctaacgcatctttggcattgcctgcaatttccaaggctaattttaatatatatgaaaaatattttaggattagaatgtgacatcctactaatcattcaaatgaaaaagtagagtggttgaagtcaccattgttctctgtagcaacaataacaagcaattgttatctttactagctttgtcctaccactcctgtgtggctctgagatttacagcaatctacaaatacataacaatcttcgtttcacaagttatggctcatgtttcatattcctttgggcctagcaaattttcattgctggtgaggtctagccattggacaaccaaaaattatgccatttttgaccttgagtcttcattaactaggagacaagtatatatgacatagtggagactgtttaggaaaagaaaggaaaggaaattcatatttattgaggctttataatgtacgattgtagtgggtactgttggtgctctgctcatattccctgagattcctgtttacattttctagtgccttttgctgccttgctaagctcttccttcatctaatggcctgcatctgtggctcagcttgggagcaaggatggcccttgcattgatggaacccctgtgtccaagaggcagagagtgggacgtgcttgagagtttacagcttcataatatcttctagccagattgattagttgagggaggaagacagcctagctctcttgccttaagtcacaacaaaatccagagcataattggcacaagacatttcctttctgcaggatcactctgagactgggactgtgcctgaaattatatccttgcttgacttttctccacactctgttactcctttctcctgggaacactttctcaataaatcacttgctccataatctttgccacagagtctgtttggaacatacttatgctatgccttctacatatactgtattacatatgctatgcctttatgaatactgtatatttaatctgcacaaaaattctgctaggaaattcatgatcagagagatcaattaacctgtccaatatcatagaaggattaggtggacttgaactcaagtcttatcccttaatttattacattttatgctaagcacaggcaagggatatggaatacgtagatccaatttggggaataaaggcatttggagatagattgctcctgcaaactagacctgaataccaacttcttacacaaaagacatcatttgagaaggaaaagataagtgcaggtttattttgctgaaaatatatcaagcataaagagtactctattttggcactggaagcaaatgagtcttaaaaactgctatgtgattagctgggcatgggggtgtgtgcctgtagtcccagctacttgggaggctgaggcagtacaattgcttgaattggggaggcggaggttgcagtgagccgagatggcaccactgcactccagcctggggacagagcgagactccgtctcaaaaaacaaacaaacaaacaaacctgctatatgtcttgtttcatgacggctttttaaaataaagaatactcatgcaatgcataatgatgctttggtcaacaacagaccacatgtatgatgatggtcccataagattataattaaactaaaaatttataccaccttagtgacattgtagacctttctgtgggacaaaatgtggaggtggaagatctgatgatcttggccctggggtaggccttggctaatgtgtgtgtttgtgtctttgttttaacaaaactctttaaaagtaaaaataaagaagtaaaatgaaaaaaaaatacaataagaatatgaagaaaggaaatatttttgtacagctgtacaatgtatgtgttttaagctaagtgtggttattatgaaagagtcaaaagtttaaacaataattgtttataaagtaaaacaattataattagctaacgttaatttattactgaagaaaaaatattcttataaatttaatgtcgccaaaatgtacagtgtgtataaagtctacaggagtttacagtaatgttctgggcctaaactttcactcaccactcccctggctcacccaaaacaacttccagtcctgcaagctccactcatagtaagtgccctgcataggtctaccatttcttatcttttataccacatttttactataccttttctctgtttagatacacaaatacttaccactgtgttacaattgcctgcgatactcatacaataggttgtctatttccagtatagcaatgggctatatcatatagcctaagtgtgtagtaggctacaccctctaggtttgtgtaagtatgctctatgatgttcacacaatgacgaaattatgtaatgatgcatttcttataacgtattctcattattaagtgagacataactgtacttgcgttggaagtggctagatccagtatcacacgcggtctttgctagaaacaaatgaatgtttgtaaacagtaaatcaatcaaatcatcctttgccattcacaaaggaagttaagaagcttggcagaaaaaggtctcgcaaaccctcaacttggatttttttttttacagcaaattagtttaaatcaatgacctcaaatgaagagaattattgtcagcatttagcttgatctttctcattaatgacttccactgtgtttctcccataattagttttataaactagcccaaaaaacaaacatacaaaatgctgggggtttttttttgtttgtttttgtttttgtttttcctttgagacggagtctcgctctgtcgcccaggctggagtgcagtggagcagctcactgcaacctctacctcccttgttcaagtgattctcctgcctcagcctcccgagtagctgggattacaggcatgtgccaccacgcccagctaacttttttatttttagtagagaagggttttcaccacgttggccagatggtctcgatctcctgaccttgtgatccacccgcctcagcctcctaaagtgctgggattacaggcgtgagccaccatgcccggccaaaaatgctttctgtaacttccacaatgaaatattattctcagattatcactaaatttaacccaaagattccattatctcttgctttttttattattattacctttggtgcttggggagttcagagatgccacagatgcaggacagtttatgactcatagcagaagcagtaccaacagtctcatgaggctgtgactggtagcctggcctccttctcccactttcctggagcatccaggtcatacacacagatacttcccagttcccctttggttgaaggagggcttcgaatcccttcactaacatccagcaacagcaatgtaggcaaacaaaagtcctaaggtctgagttctagcaagcatttggaggaatgacttacaaggaattaaagtctcagaaaataggataagttataaatattggctttccatatgtgcattcaactagcacacattaaattccaagtattttacaaatatctacgttatgaggaaagatattttaatccatttcatagaagtctgaggttgagagggattgttaatttgctcactccagtaagtgaaagagttgagattcccagctggaatctccaatctaaactcagtgttccagctccttcacagtgttctgttgggctcagaggtccacagtgaaaaaagcatcctgtgaaggctggcatccacatcattctcatgtttttgagagttcactgcaggcagttttgtcaacggcaccagattgagagtgaagctagaagaggcagacgtgggatagctatatccttggcaataagcatcaagaggctgggcgcggtggctcatgcctgtaatcccagcactttgggaggctgaggcaggtggattatctgaggtcaggagtttgagaccagtctggccaacatggtgaaaccctgtctctactaaaaatacaaaaaaattagctggacatggtggtgtgcacctgtaatcccagctactcaggaggctgaggcaggagaattgcttgaaccagggaacaagggaggtggaggttgtagtgagctgagatcatgccactgcactccagcctgggcgatggagcaagactccgtctcaaaaaagaaaaaaaaaaaaaaggaataagcatcaagagagagtagccagaaatatcaaaagccccagatagccttaatttaagggctctagagttctcctctgcaagaaacccttattctactttatagtactctatttattaaattcattcttatagggtgactaaaatgtgccagatccccaccctcaaagcacttaaaatctaatgagagagacaaacaaactggaaaatttccagttgttataactgttactaatgaaataaacagaatgtgacaatgcagagtgacattcaattgctcttacttgtttatgtaaccactttcactaacagaccatatgagctcctgggagtgatcttttgttttttattcttctttatatttctaatgtctagctaattttagatcctcaataaatgctcatttaattaattaatagatgagtgaacatataaagcagcctctcaatgatgtactctatattcatctgttctcatactgctataaagaactgcctgagactggataatttattaagaaaagagatttaattgactcacagttcctcatggctggggaggcctcaggaaacttacaatcaaggtggaaggggaagagctatgtcttacatggcggcaggtgagagagtgcgtgtgtgaaggaggaactgtcagacacttataaaccatcagatctcatgagaactcactcaccatctcaagaacagcatgtgggatgctgcccccatgatccaatcacctcctaccaggtctctccctggacatatggtacaattcaagatgagattcgggtggggaaacaaagcctaaccatatcatgctccaaagaattgctagaacagaaataagtagctcaaaggaaagcctatttttttccttttgaaactgaagctaaaatgctttcagactttctctctttgatacatttggtgttcccataatgagagacagactatttactctgacatattttctactagtggccacttctcatgaacatcttaaggtgaacaaggttacagctggctattttccagaaataattaaggataattaaaaagaaatatttaatctgaggcttcagaaaattggatttgggtttctcaattggtgttagaagtcaagtttactatcaaaatatttttaaagtgcattttgttttttaccactaaattttctgagttgtctcaaacctaaaattgaaacagtaccttcataataaaaccttccttctttactgcaatgctactttaggcaaagtatatataaaaatgagaatttaaagaaacctatatgatctgtactttaactcagccttgactaaatcacaagtttcaagtaactaaggactcatgaatgggatcccaggcacccaaaacacaaaaacatgatgaaaagtaagaagacgaaaatgactagagtggctttaaaatggcttatccaaaatataagaagcgtttttttttctaagtggaattttttttacgctctcacttattacattattttggttaactgtcttcatgtgataagtgcatttttttgacttaatgaaacagagtaaaaaaaaaaaaacataaaaattaccatgtaagaccagacccatcaatgccttatatacttttattggtgcagtttgtcttctatagcctttaacccccaacatccctttcacatctaccctgcagtttcctagtaaggatttctgggaatgtatatgaatatctgcagatattaagtagtgatgacacatataatagtgaggctttcagatgacatatatgagcatgtgacatgtggtagagatacagttggctctcagtgaatgatatatatttcacacacacacacacacacacacacacacacacacgcacatgaaaatagtttcattggggcttctctattggcctgtgtatttcatgaataactggcctgtcaataataaaaactggcacaagtattgtgtgcactctatctgctttccttgctcaataaagtgtgctattagaggtttctcaggcagtttcaaacttaaagatttaccttcacatttcaaaaaagtagccacgtaaaacaattccaaattaaagtaaatgtgtttggattatggcacaagcaagataaaagaaggatcttctcaaataagttactgtttgtacctcaaaatccccacatctgggaaagacacaaataaaatttcactttctttgttctgtttgttgctgagcacaatttaattgcaatcagatagaaactcatcctaatgacatgcaaagaagctaaaaatgatctttcggtgatgacaagaaactaaactttttcgtttggatagtcactagaagaaaaacaattttggagaaatcatgagggcataagcaggcagcataccatgcatgtctgggaggcaaatattatttatctaaatgaaacacattgtgggtttggcggccaacagcttccatgataaaatcagtgtgaagcagatgtgtgtctcagtagaaccgtgtttgatgttagccctgccacttgctgctgtgatcttatctataaaaataaagacaaaatacctaactttcttgtacaaggatgctgcaaggattggattaggtgacccaggcatgtgcaagcagccagcacaatgcttccatcagggcttgctcagtcaatagcattctgtcatctctggattgatctaggtctcagttttcacatctgtgagatgggagccgccttaagggtgttgggcatttccctatgattcacaaaggaaggtcatccagcaatcctagtactgggtatatatccaaagtaaatgaaatcaataggttgaaaatacactcctatgttaattgcagcactactcacaatagctaagatatggaatcaacctaagtgtctatcaacagatgaatgaataaataaaatttggtctatatacacaatgaaatattatttgaccattaaaaaattaaagttctgtcatttgtgacaacatggataagcctggggagcattaggttaagtgaaataagtcagacacagaaagacaaatgtatgatctcttgcatatggaatctaaaaagttgctttcatagaagtagagagcagaagaataataattaccagaagatatgaagcagagggggaggggagatagtaggcacttggtcaatggctacgaagctacaatttgataggagcaataagttctggtcgtctattgcagtgtagggtgattagagttaacaataatgcattgcatatttaaagctagctaggagagacgtttaggaatgatctcatcacgaagaaatgatatatgataaatgccgatcactctgatttgatcgtgcactacttacacgttttgaaacatcatgttgtaccccgtaagtatgtacaattattatgtgtcaatcgtgaataagcaaaaggaaggtgagaatgtgtctccattatgcgataattttctttgggggaaaaaaaggataataaacattatgcaaccagacagggcagaggtagatttcttttaaaggggagcaatcagagttctaaatgacatgaacatattttaaccatgaagaatttactgtctagtcaaattgatcagttattgccaagtgctttgaaggctctattatctttagactacctggaggaacattccatgtatttccctattctgttacattgtgcagcttatttagcaaacagttacgggaggtgtttttaagcatcaggaggaaaccaggttgtcaagaaagaaagttctcttgacctgtgacaacaaggcagtctctgtcatcctcagatttatgtaatgtgtaaagagattctcatttaaataattccattgaaataaaataatacaaatggatcatgacactgatttatgctttttaaggttatgttttatttgtatttgttttttctgtttgtttgtttgtttgagacggagtctcactctgtcatccaggctggagtgcattggtgcgatctcaacacactgcaacatctgcctcccgggttcaagcaattctcccacctcagcctccctagtagctgggactacaggagtgcaccaccatgcccagctaattttttttttttttgtatttttagtaaaggtgggattttgccatgttggccaggctggtctcaaactcctgacctcaagtgatccacccgccttggcctctcaaagtgctgggatgacagccgtgagccactgcacccagccctgtatttgttttttagatatgtgatagaagaagaaaatagaagcaatgtttttggatgctaatatatgccagaaactgctattttttcagataaataataatatcagaaataaccagttatgtatcaaatagtatgccaaatgctttgcatccattatgtcacttaatcctcatatgatgtgaggaagctgaagcatgaaagaggaaacttgctgaaaagaatcagaacctcaaatctattgaacactgaagctactgtatgtcaccatggtcctatagtatccaaatcgcctttaaaaacttacagcaaaatgccattggtttccattgggtggattaggaatacaatgggattacagcccatgtcataattctggagtagaaattctactccagggtcctggaggctttgacttatcaaacatctgaacattttaggattggccccactcactgctggacaatctgaagagaagccctagcagctcctggaaggggcagtttccagctttgtatccattctgctcactctcatctccactaccatcttctccacatcactgttgtaggatgcatatttgaattctccagtagattgtcctatggactctgttttctcaccaataattacctcctgaacaggctgcacctgaatcctatccctttcccccacaattttttttttcttttgagatggagtctcactctgtcacccagactggagtgcaatggcgtgatcttggctcactgcaacctccacctccagggttcaggtgattctcctacttcagcctcccaagtagctgggactagaggcacctgccaccatgcccggctaatttttgtatttttagtagagacagggtttcaccatgttggccaggatggtctcgatctcttgacctcatgatccacccgccttggcctcccaaagttctgggattacaggcatgagccaccatgcccagcccgtttcccctgttgaacagaatgcagactgactccacatgcttccagagcaagaagtccaaccacctaccctaccagtatttacttccacatcaacttgccaggctgcagccagacccctcctgggactctttctctgccttctcattcccatctttctctactgtctaagccactctgatcaatctgtgaatttccatgtccaggggaatcctcttccacccttcaacactcagggatcttggatatgtagctagagattaggttgggggccacctgctcctttcaccaactaggaagcacctttaaaatatcagaattattatcacaatgcatgcttctttggtttgtagtaaggataaatgagatcttacatatggaagagacaagtgaagggatacaagaatgtaagacatcctcatgattcattaagagatgcatgcattctccagctatggggacgcataatttttgcttttatgtttactttgggaatagtactttattttacttcatgctcctctatgaacaagagatctatagtgtgtcctacagggaaatttaattccctcttttattcttgcaaactagtaagttacaggtttagccataaagaagcaagcaggcatctctgttttcaatgctctctaaaaccaaacaatcctctggggattttggtaaaatgcagattaattcagtaagtctggggtgggacctaatattctgcatttctaacaggctcccagatgatgctaattttgctggtgcatggaccacactttgagaagcaaaaccctagaacattacaagaaattcctaatctccgtgatctgctttgtttcaaaatatttcctttcttccatctttcattagcttttacttatttactcaagccttattcccaagcaaaacaggtctcacccaattagaaagagtcaaagacaaaattgctgacaactctcttggttttctatgctactttcctcttgatcccactgaacgtagatcgtgtagaaatttagatgaaggacacatttaagacctactcttagcacggctgatacaaagtcatagctctccagtacatattttatttattaggaaaattgaatcatggaaaaataaacagagaaacctgaagaggaaaaatatgaatacagcattaaaaacataatttgcctttcaaatagaaataataccagccatttattaagtacttttcttgtgccaggcatctcatttcatgaataatgaaatattctggaaatgaattattatctgagaaatttgataaactcagaccgatcctgccttgttttgtgctatgagacattaatgggattttttgcaactgtgaaatggtaggtatttaaataggagaatgggaaattttaatttgatacggttggcaaggtgtttgatgaggctgtcacaatgacaacaaaatttaaatgcatttattgggattacctgtgctgactgaaatgcaaaagacagaaaaggattcattcacactgacttattttgaatgtgatgcaaatgtaaagagtaatatgatgtggcattatcatgatttctagtaagaaaacactgctgtttggtttgggccaaagaatgaggaaactcatagaggatggctctgcatatttctaaaaccaaaagaggatccagtacaacaaagaatcaaaaccctggacactggttaagaggagggatgaatcactggaatcacttgagtccttagtattttgctgaaatgtattatgcaatatacatccttttctccgcccaatttttgtcctggctgtgaagatagcagttctttatgctttgacatttctgttttgagtttcaaagtcagagtgataaatagagtagaagaacttaggatttagacttttaaataaagccagggaatattctattaaaaaaaataaagagaaactgttgagggacagagttactagctaatttatttatttatttatttatttatttttgagatggagtttcgctcttgttgctcaggcaggagtgcaatggcacaacctcggctcactacaatctctgcctcctaggttcaagcagttctcctgccttggccctgcaagtagctgggattacaggcacgcgcaaccacgccaggctaattttgtatttttagtagagatggggtttctccatgctggttgggctggtctcgaacttccgacttcaggtaatccacccgcctcctggccttccaaagtgctgggattacaggcgtcagccaccgcgcctggtcagttgctagctaatttatatacttttattactgttgtttgttttaagacgaagtcttctgcctgctcacactatacagaatgagcctacaggaacaaaacataagaggtgcaatttgaggactgtcacctctgcctgagaaagtatctccatgggtgcttattaataatgatatattttaaaaagttgtaacagaaagttccaacaggttgaaaacatattatcttctcattgacaaaacagatagcatttattataccatgtgtggcaatttatttggcacattgtggcatccctttttcaaaggcttttcttgccagcacattcatttacctcttcatgatttttttggtcttatgtttttaacaagactgagcagaaagttgaagactatgtgatagatcccttgtcatcttccacagtgcttaccatataatgattggtatagataatcttatggatgtcatgtcttcaatatggcttataatgaaatgatagctaccatttcattgagtgtttcctatgtgatagacattctgatgagttttgtacacatataattgacacatcctacaataatgcagctaaggaggtattatttttaacacatgagaaaatggagtcacagagacttgaatggtgagtctcatttacataaatagaaagcagaagagccaagttttctctgactccaaacgtatgtatcatcacccccaatgctagaaaagtatctaagaagactatatttaagaaaagcctcatattgctggcctatttgattttagtctgttgttttgtcaatccaatctaattccacatgccaaaataattgtcacatgttagtctaaagctaacttcatgtctgatagcctagagcagctaccacattcatttgctaataaaatctgtcctccgtagtctggctttcaagatatttatccattaattaattcaaatctcatctttactcattctcctttaaagctcatcagatcatttttaaaaataagtttctgccaatatcatgtaaattcagcaatcacagtccatctgcaactcccccatatgtggagggggcctagttatatggtgggaaaaacaactgggcttgaaagtttttagtacattcttacagcaacatttcttaattccctgaccaagctgtctacaactgtgcacctatctccacaattattttgtatctttaccctgagttatttttcttcataatactaattaactgtattagtaaggttaagtaatgctacattattctgtggaaataaacaaacctcaaacctcagttggttatcataataaatttttttgtgtgtgctttccttatagcctgatatgcatcagatcttcctcctctatctccttgctgtgtgatctggaacatgtaaactctaaagagaagatgacaagaagagatggaagaggctgttcactggcttggcttgaaagtgacgtgcatcacttttgttcaccagtcaactgaccagaacttgtcacgtggccctaatctaattgcaaataatgcaagggaatgcagatgagcatatgtacatttgttacgcactatctctgtcacattacctcacagaacagtatatatttatttgcttctctcccctctctcccttcactaaaaaattcatttatatggctacagattttgttgtattttccatgccaataagatcaagtagaacagtggctggtacacactggtacacagtgggtactcaaaataaattgttgagtgaaagaatacttgtaagtgattaaagatggccacacattctttgatggttctttcgttgagaagtggcatgaatttatgataactgtgaccaaacaatacggcagaagtgacactatgctaactgtaggcctagcttgcaagagagtagacagtttccactttcttcctagtggggcctatcctgagtccaggaagcacatgctagccacttggggatgctgcatggagagagagagagagagagatctaaacaacccccagctctttcagtaccttctgtttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagtaccttctgtttatcttatgtgaggtcacagacattgcagagcagagatacatagttaccctccaaatccttgacccacagaataatatataacaataaataaatgttgttttaagcccgtaagttttggtgtggtctttaatattatgcagcaatagataattggactaatattcatgatgactgacccttgcatgttcaaccccagtacctacagtctaaactatacacatttattatctctaaggaagaaaggctcaatgtttttaaaagatgcctattttttcgtatcaatgtacaagtgtttctattctgtgaagtctttaccctctttctggtcaaattttgaagactgtcttcttttatatacccagaaagttctgcatggatacatcctgccatagcactcaggacacctgattacttctgtgtgtttattcttttgctgtaatctgtacaaggatgttcactatgtgacacattccaggacacattctcagtgacccctagtcattctacactctttaccttccactccaggtggcaatttgaaacacaagtcaaagagagtgatgttcttacaggcatggtttttaacctatgcccatgaattaaaaacaatttaaaaacccaatctttcactttagctgttgttagttaatctcacttgtatacacattttacaagtgactctcatgcatcttgcagcttatataaccaccaattcagacaccagaggtgacagtagctgctataatatactcattggtttaaaagtgtttgttttcctattagttgcaaaacttttaagggcaggcagcttgagtcccagttacccagttgagataacccacatctgctaatatttttacataaaagtcagtgaaaatataattggcaatgtcatgcaaaactggaaataaatatttactatttttaagccattttggtctataatttaatcacaagatcgttatacttggaatgcaaaaggattggatcatggtggcactattttaaagtctcatttaaatataactaaatgctgcaataggtggtcataactgtagtttgactctaattaatataaaataattggagagtaaatttatccccctgttccatatcaatagctctttggctacaaggcaaaaagaatgtgaacattttctcggtatcaataaaaattagcttaaatatctaagtcaatttagaaatgataaatcagtctccatagttaaagaccaaaattttaaataaccatattaagcaagactcatatatttttaggaatgctctcaaaataaaaatctctcttacaaaccaaaggaaacaaatatagttgaataattctataaacctttcacaaaaatatggcattatggcataaggcaaatatgatggttcaaccagctaagtaaacactgattaagaattaagattgaccacagcaataaggggtattttcctctagtcaatcactcaggttcagaaataccaaatttatcttaagacattctaattaggcaaaactatttgatagatcgagtagttggagatcagaagcatgcatccaattaagaagaatgttattgaatgattttcattcactggcctcttctgttctctgtattttagtttaccttcagcacctcattgaagagagctatatccaaattcaatttattgccccaagacctctttcaaaaaaatggctctggagattcccagctagaaaaacttttctcttctcctaagcttccataacatgcatcagggatttggtatttctccctctgaattgtaattgtttctaggcactagcttctctgccagcctggaagttccttaaggagctgagcccatgttttattcatggttgttcctctgtggggcacagcacttgggcttcccttctttgagcatcaaaaacaagtgtcatttttctttcacttattttcacatccatgtcctcttctaagacctttgcaagtcattcgtagttttaaagagactacatttaagttttgatagataagcaaggtaaatggcaagtccagcagtatagagaaaaacctctttcctgtagtggtatttgttatatattttatctgaattttgaggttcatttgttttcattattgacagatgatttctttgtttgtttaataaaaagcagtaattaattttcccttaattacatgttttacttgccactagctggtgtatctagggattcatattgtaaaaagaaatggaactcattggtttgaatcataatgtgtgggggtatagaggttatttaaatattgtttagttctttttttttattttacacataatagacaattctcaaaatggcagtaaggaaaaaacaactcattctttatattttgaaaatttttggccctgaacacaaaactttaattgtaacctttaatttattaaataaaatattgagcttctaaaacatttgagagtgtgcagcatattgcaaaagatacttggaagaggcaagctgatcttgctccaagaagcttctggttaaatatcaatatgatgaggtttgaaaaaggtacacacaaccactacattacagcatgaagtaagatttaggctgcaagagagatgcaagttacaaatatgaaataagtttgggctgcaaggaaaattgactctggcacaagttcaggagcattttagattagcaaagtagaattgctgggagttcaggtcttagatatttcataaaataactacacctcaatacattggaatttagaaataaagagaccattagtgagattccatttctgcaatattgttttttctaactttgtcccttgttttttgtctgttcctatcctagtataccaaattatcatcatattccctcccatccatgattctagcattttagataaatcgtcttgccattttccaagcgtttggaattgaggtccatgctcatgcccttttctaagaattccaaactccttgagcttaatcttatatcttcttttaatatccctgaactaaatgactctaatctagaatttgtacatatgaccaaaatgacaaaggtacttcccatgaatccccaaacctcctgatattgtatataaaattgtgaattttcctggagttagactacatgactttggttaaatcctcaaaaggagctcctgccccactgaatttaagaagttttagtacttacagaccattggggatatattacacacagaggaggtacaggcaatgtcttacaaaaggcacttgtaatggcagtctttatgatttctaggaagtatgcagaaaaatttcctgaaggtaatggtcatccaaaaagtcaccatggaatctcttctcctgcaaggaattcattactgagtaactccttacctcttggtataattttggcatggagtgaaaggtctaacctctcaatgctgtttccccttctgtacctcctctgtctctttcaggcttaataggatcatctgttgacttgaatcagagtcacattcaaagctgtgaccatcactgacttggcactgtctgtatctgtgtgagtctccaggagaggtgctagtgtctggggctggaagggtgtaggttgctggtaattcagccatgtgcatttgctcatgaatatgtgtataataagagagagacagagggggagaagaagtggagaggggagagagatgagagagagaaagagagagatcaatctgagagagaaagatatgtatacacacacacacacatacacacacacacatatatatatatataaataaaaatctgagagagagatcaaatctgatctgtaattgtatccacttcagaccaaagggaccacacagataaatataaataagtgaaaagattcagtggggtcaatggaaatcaagaagagggcagtcttggcagtttcttctctattctcactgatttcattgattaaacgagaaactaatgtcaagtcagagatatttttatgcaaagctgagaatatggatttttgggtgcaattttccaaagtctatgcattaacaactaattaaaaacatgtaaaagaatatagagcacatagaggaaaattttctcagtttgataaagaatggctacagaaaacgtatagctaacattgtacttaaggtaaaaaaatctagacactttccaattaaggtcaggaacaaggaaggattcctctctccacttcttttcaacattgtgctagaagtgctagctaagaaaaacaagacaaaataggaaataaaatgtaaacaccttgtaaatgaagaaataaaattgtctttgttctcagatgacatggtcatctctgtagaaaatacgaaagaattgataaaaacaactcctggaactaagaagtgatagtaaggttgcaggatacaagattagtttataaaagtcaatcacatttctatgtaccagcaatgaacatatagaatttgaaactaaaagtacagtaccatgacattagtatccaataaataaaatatctaggtataaatctagcaaaatatgtacaagatctatatgaggaaaactacaaaactccgatgaacaaaatcaaagaagactaaataagtggagagctatcccatgcttatggataggaatactcaatattgtcaagatgtaagttcttcccaatttgatctacagatttaatacaatcctaatcataattccatcaagttattttgtagatattgacaaaatgattttgtagatattgacaaaatgtagatattgacaaaatgtagatactgacaaaatgattctacataatattgacaaaatgtcaatattacgtagatattgacaaaagtttatatggagaggcaaaagatacagaatagccaacacaatattgaaggagaagaacaaagttagagaactggcaccactcaacttcaagatttactataattaagacaataaacaaagaggctgggcatgctggctcacgtctatgatactagcactttgggaggctgaggtgggcggatcacttgaggtcaggagttcgagatcagcctggccaacatggtgaaaccccgtctctaccgaaaatacaaaaattagccaggcgtggtggtggacaactgtaatcccagctactcaggaggctgagacaagagaatcgcatgaacctgggaggcagaggttgcagagagcagagatcacaccattgcactccaacctgggagacaagagtgaaactctgtcaaagaaaaaaaaaaaaagaatagacaaagaggtgaatggaatagaaaaaagaattcaaaaatagtcccacataaattagtcaactggtcttttacaaaggagcaaaggtaatacaatggagtataaatacagtcttttcaacaactgcttctaggggtgccagactcaacaaacctgaatactcacatgcaaaaaaaaaaaaaaaaaaagaatctagagacagaccttatactcttcacaaaattaactaaaagcagatcatatatctaaatataaaattcaaaactgtaaaattcctaggagataacatagaagaaaacctagaagaccttgagaatggtaatgacattttagatacaacagcaaaggcatgatctatgttggaaatcattcatatgttggacttcattaaaattaaaacctttttgctctgctaaaggaaatgttaagaaaatgcgagacatcatacactgcaagaaaatatttgtaaaagatacatctgacaaagaatcattttccaaagtatacaaaaaactcttaagactcaacagtaagaaaaaaacaacccaattaaaaaacatgttaaagaccataataagaagcacctcccaaaagaagatatacagatgggaaatagcatatgaaaagatgcttcccatcatatgtaattacaggagtataaattaaaacaacaatgagataccactagaaatgtatttgaattgccaaaatccaaaacactcataacactgaattctggtgaagatgtggaacaacagaaactcctatgcattgctgttgaaaaaggcaaaatggtacaaccagtttggaaaaccttttggcagtttctataaaaactaaacataatgttatcatatgatccagcaattgtactccttggtatttatccaaagaagttaaaaattttgactgcagaaaaacctgcacatagatatttatagtaggtttgttcataattgctaaaactggaagcaaccaagatataccaagaaaccaaaaaactgaaagtacaaaggtggtacatacagacaatgaaatattattcagcactaaatataaatgagctaacaagccacaaccaatatggaggaaacttgagttcctatatttaattcattctccctattactaagtgaaggaagacagtctgaaagggttgcatactgtgtgcttccaactgtaatacattctagaagatgaaaaattatggaaacagtaaaatgataagtggctaccaagggttggcagaaagggataaacaggtgacacacagaggattattaacgaagtaaaaaatactctgtatgatactgtaatgatggacacgtgtcattatacatacatttgttaaaacccctagaatgtacaatatctagagtgaaccctcatataaactacaaactttggggaattatgatgtgtcagtgtaggttcatcaagtgcaacaaatatgccactctggtgagagacgtaaataagaggagaggctgtgtgtcggggtgggtagggaacatatgcagtatctctgtgtcttcctcttcatttggctgtgaatctaaaactgccctaaaaaagtctttcttaaaaagagtccagaacaaagacaaaacgtacatttgttgatatggaacctaggtagtctgaagtttgcatactttcatctatagcttaatctccccacctattttcctccaccatctttgtagtaaatttgaactattctgtatctacaaaaaaaagccttgaaatttcctcacagcttattcttataaaatcctctcagtttacaattcgttctcttgactgttctacttccttactctaccagtcccagattatccgcctccatgatgaatcattttttcttctaggaccatgaaacatataatctctatcatctgcatggcaaattgtcacgtatttgtccactgggtattctttctgatgttgctgttgttattttcacatgttcatgtgtctgtctcatttcccttcattattcattcatgcattcattcatttgccctacatacacccattctatattctgcatccttgtgcttgacactgaagattagaccacagagcaagactctttccatgctttgtaactcaccgtaagtgtacttctaatacacaagatcaatcaagaaggctattataaacctttgtgacctgaaaccctctgaaggctgtttgtattgatatggtggtatggactgaatgtttgtgtcccctcaaaatttatatgcagaagccctaaatccaatgtgataatattgggaagtggggcctttgggagataattagatttcgaggaagtcatgaaagtgggttcctcatgatgggattagctcccttatgagaagagaacagagcaggctctctctcagcctaaggtctgactgatacacaactggtattcagaaatatttattgtttggttacttattctcatttgcaataagttataacatattaacaatatattcctacatttcacagtgtggatgctattgttgttgccactgggtatctatgtgggaactaattgaggaccacatttacaatgtgcccaaattgtaaatgtaggagtatctatgtgggaactaattgaaccactgagtatctatgtgggaactaattgaggaccatgtttacaatgcgtacaaatcataaatcaattagttcatattgatttacaaacaaggaagaaaaagtatttgtttacattgatactgtccatgtaaacttttttcaattcaaaagaaacacatagttctgtcataaagtagattttctatcccttttattttctgagcttatttcagaaagcacttgcaatagctttgcacagttcagcatttatgaaggaaacctttgttagcctaaaatgtagctgtaattttttttcaaataatttctacacaaagcttttacaccttatttgattacctcaattttttcccaatgagtgaatacggacttaaattcattttttataaaaagcattaaccattgtttcttgtaattacactcagtgagagtcgaacaatagtgtctccatttgaaacagacttttgttataaggttgaaattgactttaaattcttttgaaatggccccaaaataacacatagcacagtggtcgtctttgaggtgagaattatgtgtcttattattgagagattggactgtgtttcacagaaaaattctcatgacctactaatgtgtttcagtcaattgttctgaaagcacaggataagaattgtaatgataatgatgaaaatatatgaagacattgaaaactgaggttctcattgttatagcatgtcagttatctttatctcattcaacagcatattttaaaatgtcacactgatttccaaagaaggaagaaaaatttaaagagttcaggcaatgcatgctagttaaacttattgtgataatacattcatagacattgaaaatattggacaaagaatgaaaaaagagagaagaaaagcatgcctaaagatagtcagtgcttggccagtatatatcttagggcagaattcaatgactcaggttgaaaaataaaaacctatctagatattttgggtttcttctctctctgattaatcaaaatacaacaaggcagaaatgaggaaagatgcaaacttttagtggccaatgaggaaatataccttgggggcatatatggtgagtccaaagattggtggccaagaataatagaaaaagaagagatgcagtagaacaagaaggacatatatcatcatttatctctgctccatctctccatttattctgcaagtgatgggcgcaaaggaagaaaacctgtgcaggaattaaaggggcagctctacagagtcactgagagctcattgtccagacttggataaaaatgggttcctagtcctgcctcagtgagtattacttgtgtccatgatcatgtcacttactgcttctaaactccatttgtttcacctgtaaaatggggataattatggtccctaaatcatagacactggagatattaaatgatataatgcagaggaagaggactgagtcaatgtctggcatttactaagcctccagtagagcctagccataaggtttctattataattaaaaacatataaggaattttaaccattctttgataagtttagttacccaaacttttttctataataagctgtcctataacactctagaactgaagacatgtatcctcagccacactatgtttgactcagctgtagagagctgtcttgcccaatgactgactgtggtaggaacccctgattcttctgattaaaaatgatattgtttgacagtgtccccacccaaatctcatcttgaattgtagctcccataattctcacgtgtcatgggagagacccagtgggaggtaattgagtcatgatagtgaataagtttcatgagatctgatgattttatgaaggggaattcccctgcacacactgtcttgcctgctgccatgtaagacgtccctttgctcttccttcatcttccagcatgattgtgaggcctccccagccatgtggaactgagccgattaaacctcttttctttataaattacctagttttgggtatgttattattagcaaagttacacaagataactctgacaccacagaactccctgaggtgttgattaagactttgtgggtctaaaaatatccgactttttcctctgagcaattgtacttctgtactccctcttccagtgacgttaatctctaatcctgaatgctgaacttctggagaacccaatctggttcattagcgccaactattcaaattgtcttcagggagctagtgctttccttctttctcacaaaattacatggcttacattttctgctgctggggaaccctcagccatggatcctaaggccaaggatggacggagaaattccctgacagtctattctaggaccatttgaaaaagagggacccgagaccacaccagagaaggagagagttggggacctaagtcctggggaaaggaataacaggaattagggcctgattactgatctgggcctgctatttttaaggaaagtgtatttatgggatagaggggagggggaattattcatcatgatattagttatagattctagagatctagagaaataagcagaaaataaaaactacaagaagatgtttaacctagaaaaatgaataattactaattaatttatatgcatctcttttcatttcattcatttatcactttagtcactcaacacaatttaactgagaaattatacaacatgagacactgtggtagactgtgtggggtgaagcgttgactgaaacctggcccttgtcttaaaaaaagaaaaactcacatttttgcctcattatcttccataacaacataaatatattttattatacatataccagatacattttgtttgtcctaatcaattctgtcttatgggaacaacctatacctaaaaagattggagatttgtatcacataaaatgataaaaattttgtttcattattttatagttatagctcagaagttccagtttcttggtgttcttttctggtattagaggtacctgcttaaacttttacaataaagaatgaaagcattggctaaatgcattcccagaggctttgaataacaactctggcaactggtttgcccacaaaattgagctgatttataacagccttaaaaaattaattaaatgcataatatatattagctgaataatagactgagttgggaaggtttttcagtagataatatcttgcggttaacccagaattttttccctacacaaaattaggggcataaattactattttatttttagagaaactgtaggcatcagactggatgttacaaaacagcttcaataagacatagaaggccattgcattcctcagttaaagggaatgtttgttgcaaagataattattcttttcacaaacacctgtgcttccttttcaagtgcagagtaatactaggcagtggctgcccagccaagaacattacctgctccggttgcatataaaggagtcatgtgactgatttcagccaatagaatgctcataagtaagaatagttaagaagtaatggggaccctttccaacttctctccctccaaatgcaagcatctagctaagtactcagagtcctgaagagattgctgaagcaatagctgggaagagactcactccttaaagaattgtttgaaagaaaacttctcacgaatcagaaacacctgtttagactttacaagcatgagctatctccttctatttgtatatttatttgttacagcagcaagcattaccttaaagtatattgaaagcgtgtggttgaatgtgaaaatgttgtacggaaagatagggaaacatatgctaatgacaaattgggtccaagataacgagcctgttaaaagatatgcacgtcttttaaatgatcgaatagaattcattataacattttattcccagtaggaaaaattagatttctaaaagaatggtagcacttgtggcaagatcttatgttgcaagtacagtagatgaatgaagagaaactgcttaacccccattctcttaaagattaacatttataatttgtaatttgcctttttacatgtgcatctgtattaacacatgcccatctgaaaatatattcggagctttaaatatatactatagggttttgtcaagaattattaaaggagataggatcacatttattcaatgtgataaataattctagaccctcccatttggagaagaaaagaaacaaaaatagtttactggcttataatatgcatgcataatttttctttttcataacacaataataatgatacaaaaaacactataatcctatataagcaaaagtgcttagttctgggtcaggcaaattgaaagcaaggtggtgagccagactcagcaccatattgatgagaatcacaccttaatagatggagaagcaagtagaaaggggtttagatgatcttacataacagaggcttttaatcaagctggaaccctgcctacctctaaattattacataggagaaaaagacttttattttaaaaattcaattgtattttaggacctttctgtaacaacagtgtgatctatgcctaaacattatatgatccaaattgtgccccttgaaatttcttatgttgaagccttagttcccagtatctcagaatgtgactgtatttggaaatggggcttttaaaaatgtaattaagttaaaatagagtctttagggtaagccctaatttaatgacttgtgtcctaataagaaaaggagattagaacaaaaacaacacatacagagggacaaccatgtgaagacacagcaggcagatggccatctacaagccaaagagagagccctcagaagaaatctatcttgttcacatcttgatctttgacttccagcctctacaattatgagaaaataaattgctgttatttaagccacccaatatgtggtacgttgctatggcagccctggaaagtgaatacaaataatacataattcatgcattcattccttcaacctttacttagcactaattttgtcatatgtcctgtgctaatggatgtagatgacaatgtaaattaaattctcctatgtcctcaagcaaatcacagacaaatggataagaaatctctccttccattatacagtggctccttattatggaatcttgctatttaaataaaatatattccatcagtgataggttaaatggtgttctcccaaattcacatgctgaagtcctagcctctagtctttcagattgtgactgtatttggaaattttgtgactatagatgtaattagttaggatgaggtcagattggattaggaggccaacctaacccatatgactggtgtattagtcaaggttctccagagaaacagaaccaatcatatatgtatgtgtgtgtgcatgtgtgtgtgtgtgtgtgtgtgtgtcacacagagattattataagaaactggcacacaattatagagtcaaacaaattgcaagatctacatggtgagtctgcaagcaggagagccaggagagctggtgctatagtttttgtttgaccctgaagccctgagaatcagcagagccaatctttcaacttcagtctgaaggccagcaggtgccagacccaggaagagctgatgtttcagtttgaatttgaaggcaagaacaattcccctttacttgagggagggtcagcctttttgttctatttaggttttcaacaaattggaggaggcctgcccacattaggatcattaggaggatgatctgttttgctcagcctactgaatcaaatgttaatctcatcacaaaacattcttacagacacactcagaataatgtttgatcaaatatctgggcaccccatggcccagtcaagttaacacataaaattaatcatcaaaactgatgttcttataaaaaggggaaatttggacaacaaaaaagacaagcatatagggaagatgggacaatgtcttttaccatgagcatatcaggctaccagatgctagggagaggcagggaacagctcccttacagccctcagaaggaactgactctactgacaccttgattttgagctcccagaatcaaaattcttgtcttacagtaagacaataagtgtctgttgcttaagccacccagtttgtgcaactttgttatggctagctttaacaggttacaccatctattctacactaaagttaaatattttaaattctggaatcagtaaacaaaccctgctacttgccatttggggttaggggagtaagctatgtcagtccttcacagtttcttttcttgatatctttttatcagcaattcactgatatacccactattctttcaaccaacacttattaagtgtcttcatccatatctcttgtattgtgctataaagcttatgataaataccactgagcagaggatgctaatcacagagttaactgtagtgtgattcttggggatatgtcaaacaatgaactgagactgatttatctttatgaattcaagttgcttatatcacaccagtctaaagaaaataaattccaaaaataatatcacttttaaatcaaaattgagagacaagaatatcaaagagactggatagactctaacttttatcaaaaaatgatgtagataccagtgggaaaaaaatagaagattcttagaagatggttattttagagatttgaggggaagtaaagagaagagagaataaaaaaattcttaatcaaatgactcaagtttatattaataatatgaaatatttttaattatctcacaaactgaatacttgcatccgagtgtccatgtcaaggaaacaattttgtgtttaaacctctgcagatccaaagattcatactaacatctcaatggttgaaaactgtcattgaaaggaaacttgaaaataattaattcttaaactgcttaatttttcacttttcatttcacggtttgtcactaaaatagtaattattttttcttctcttgctaatccaacaatttcatactgacagcctttcactgggaaatttactttcatattactgctttacactttaaatacaaatatttttcaagatgaaattagatatgttggcaagaaatatgatctttagttaatgatttatgtttctgctttggaaaaagaaatgtctcttacatatattatacagacaagtggcttccaaacattctgttgaagtgttcaaagggaatgctttatgattattgctcaataaaaatagtgtgttggcatttttactcccgttacctcacaggaaaaaaaaaaaaagaaaatgctgcaatagtatgtcataacaattaatagtatgtacactggattttggtagaccaaactataagtcctggattttattttaccaattctgtggtttaggtaagtggtttaccatttatgctatagttatcttagctataaaataggaccattggagtatacacctctgaaggtgtctggaaagactgaataggaaaattcatggaaagaacttatatagaagggaaataaataagtgctcaataattgttagttgaggctgtaataataattacttattgagtgctattcaagggccagggattgggctatggagtaaagacataaaaatgaggaattcacatgtttctgggacctcgctaaatgtattgtgaaattaaaaaatggcggtatatgtgaaatcactttgaaaaagaaaaaaactctacataaatacaagaaaaatctctcaagacagatagtagccaatgcacaatttaattccaaaacatgggtcagcttcttactttggaatgttatagttttaatttaaattattgccaatatttaatattaaatacattgaccacctgttcattaattgatgaactcaattatactatcacttatgcattctccaaacatgtacaagtgtccactctgtcatgggaactccccagccattctggcagccctatgttttgtttctcaagcacgtagtcacacctttcttcccctttaatgtcagcttattttttcttcttggttgactttctaggggtgttctatgacacgctgagcagcttgtggtgaacgtacaagtgtcttaaaataatcgagtgtccctacactaccaaagtgttaaatctaattgaagaggccaccatgaaaatgagtatctggcacagccttggctgggcttaggaaagcaacaatttgagaacctagatgttggcagatgaccgtattaagatctactggaactgcatttaaagatttcatatgcatgacaaagcccatctactcctacaattggtttgatttacagcccaagataatggtgcttctagtatctcaaatactaaaaaaatcatatttaattgctttaattcactattaatcgattattataatgtactgctaaaggacaattctttctaagttctacaagcacaaataacatgaccatattatctttccaaattgctgactgtacaatattgtgggaatataaactacaatataatccagtggtttagtagctgttactactgtgaaaaaaatatttaggaggtcattatatcatagattggtatcatttgtctatatatatatatatatatatatatatatatatatatataactcaattttattttaaaaaatagtaaaagcaaacatcacatgaattaagaatgtattttatactttaagatttattttcaaaatgtgaatgtaaatcagatcttcccatcacgaccccagaagaataatgatttattttaatatttgtgattttaggatttagatactacctacttaccaagatactcacttgtaaaatatcttttaagaatatagaggcaaaatagtgtagcatagaaaacacattgaaagttcatattaatagccccttcgagtttttatagaccctagggtaaaaacaaacaaacaaacaaacaaaaaacctccatcccttgcctcagttctcattcatgtggtttgtttataggatcaacaacaccggtgggaaattttacagtattcttcttattgtgggcagctctgatggctccaaggttctttcttgtgctgagcaggaacctatttactgtggcttccattcagtttcagtattccttttagggctaaggaaaataattctcagaagaaggccaagcaacatggtcaaatagaagcacccagcaattatctctcttctgcaggaacaccacattgaccaactatacacacacacacaaaagcaccttcttaagaatcaaaaatcaggtaagtgatcacagtagctggttttcacatcatattgaggaaagaggcactgaagagggtagaaaagacagtctttaatcacctataccatccctccccccatcccccgcatccccctcatcccctggcatgtattgccatgcggcactgagagaatgtctgcgcctggggaagggagaatgcagtgattgtgagacttagcattggaactcagtgctgtcctgtcacagtaaaaagtaacatggggtggaagtcagccttcatccacagagggagcatttagaccaaccctagccagaggcaaattgcccgtcccagttgtcagaacatgagtttcagcaagccctgccaccatgggcaaaaggactctggggtcctacatcaacttgaaaggcagtctaggccatgaggactgcaatccctgggcaagtcctggtcctgtgctgtgctgggctcaaaggggccaggggacttggagtgcatgtgacctggtgagataccagccgggatgcatgagggatgcttgcaccaaccctcctcaaccctaggcagtatagttcacagctccaaaagagactcattccttctgtttgaggagaggagaagggagaacaaaaagaactgtgtcttgcaacttggataccagctcagccacagtaggacagcgcaccggacagagtcctgaggccccattccaggccttagcactcagatgacatttctagacacgcattgggccagaagataacctgctgccttgaagggaaaaacccagttctggcaggattcattatcttctcgctaaagaacccttgggccctgaataatcagcagtggtagctaggcaatacttgcctctgatcttgggtgagactcagaggtgtgctgacttcaggtgagacccagcacattcctggctgtggtggctatggggagagtctccttctgcctgaggaagggagaggaaagagtaaaggggattttgtcttgcagcttaggtatcagctcagttacagtgagatagagtgccaggcaggccctagggttcctgattccaggccttggctcccagatggcatctctgggtctgcccggcattaggaggaactcatcatacttaggaggaactcatcctcttagaaagaactcatcacactaaaaggaaggacataagcctggataactttgccacctgctgagtgtagagcccttggtccatgagtgaaaataggctgtagccaggcagtagtcactgcaggccttaggtgagacccagtgctgtgcagtcccagtggtggtggccatagggatgcttgcattacccctctcccagctccaggaagctcagcacagagagagaccctgtttgtttggagggaatgtggttctgaatcattatttaggggaatattgtctgaacatggtctactttgaagtttctcaccctttctcataatatgtcccatcaacataaatattatcaagcttcatttcctataattttcattatgttgcccaaatgaaaatattctgttgcaaattattgaaatgtaaaattttgtattaaagtataaattatttgttaaaatatttaaaatatgattggttattctacatacagaaatgtctttggatatctcagtatgttctcatctttcccctgtcctatcattattcttccagtgactcatgccaagaattgatcacaatgctccaagggtggtctgaccagcagggaactgagcagaactgaacatggcttcctgttttctgtacccaatttctttccctttttctggtaccactcatgtccacatcataatcatcttttgcctgaacaatctcaacaggctctgacgtggtcgtcctgcttcccccatgaatcctgagtgtttaccttccacttagtagctaaagggctcttttgaactcataaagtttatcaagtcatcacctcctcaaaacgttctatacacttcccataataatgagcatgaaatccaactccataccctatgtggtctatataatctccctttcctcagtctccccttattccattctctcttcactcatgaatttccagccaaaattttcttctaatgtctcaatgattaggtcaagcaggctccacacagtagggtgtgtgcactgattgtctttgtgtggaatactttctctctctctgcatatttacatggctgtccttttcttgtcatttagattttagttgatatccctcctcttcaatgaggactttcatggcctccaaatagtaagtagcttctttcatcaacttttatcatgtcaccctaaatgtagtaatagtacttgccaccataaaatattcttatttatttgtttattgtctagctgtctaatgaggtaagacccacaacagcagtaatcttaataattttatttagaataatgtttggaatataaatattgttgagtgaatgaatgcatgcatgcatgaccacagtatagatgtgttattgtatatgaagctattaagatcaaagagtttgagcctgggcttgaattgctgatctacatttactatggtgagtctaaacaagttacttaacctatctgtgcctgagattgtacatctaaaaaaggggcagataaaaatgttactttcttctcaaggttattgtaaggattaaataaataaattgctctttgtaaaatgcatagataactactgtataaatgtagcaataaatagtagtacaacccaatttttagaattttggcagccacactattgactcatattacacctaaagtataatgtaaattctctaagtttttttttttaacgtgtgctgctttgaagtctcacctctatatttttgtgcttacacagctgccttttagaagccaactacaggattttatattggtccgctttatttggtttcattcagcacatcattctactctgttgacaatgctgaaggttttgagttattgattaaatgtcaccttggatatttgaaaccaggacttcaatctaaaaatctaagctacttaactcaagtgacctcagtctagaggactctgagtattcatggggccagtgtgttgtcttctagcagtttcctttcacttgcccggagaagaggcctgtgaaggctggccctgggtctgtaaaacacataccagaagtgggagaggacataggttaaaagcagattgacagaggaggatcaaagaagccataagtatacctcagctgacaatgaccaagcttatgggaagaagatacagaaaaatagaaatttggatgtagagcaaatcttattttttcactttttattttgaaataatgatagattcataggaaattgcatagttagtacaaagaagttctaagtacccttcacccatttccatcttacatagtacttaacaccaaaacacgactttgacgttggtataatgtgggtgtgtagttctgtgtcatattagcaaatgtgtagatttgtgtaatcaccactataattaagataaaaaatattctatcaccacaaagatctctcccacactttccttttacaatcacgtacccaaaccctcattactcctgactctgggcaatcactaacctcggatccaactcgataattttatcactgagagactactatataaatggaatcataccagatgtgacctttcaagattggagttttcactcaatataatgcccttgtgatccatcctagctgttgtgtgtatcaatagtttgctcatttttattgttgagtagaattccatgctgtggatgtaccagagtttgtttaactgctcacccactgaggcatattttggtcttgtttttggcgattaaaaataaactgctgtgaacaatcatgtgcagattgttgtgtgtctaggttttcatttctctgggataaatgcacagagtacagttgctgggttgaatggtaactgtatgtttagatttttttttttaaagtgtccaactagtttaactagttttttgagtggtgtactggcttatatttccattgtcacagtttttactttagctgttctaataggtatgtagtgatatctcattgtcatcttaatttgtatttccctaatgtctggcaatggtgattagcttttcatgggctcactggacacccatattttctttatgattaagtatgtgttcatatctttttctcattttctatttgaattgtctgtttttactgttgagttttgagattttttttttttttttttttttttttttttgagacagagtcttgctctgtctcccaggctggagtgcggtggtgcaatctcggctcactgcaagctctgcctctcaggttcaagcaattctcctgcctcagcctcctgagtagctgggactataggcgccggctaccatgcacggctaattttttgtatttttagtagagatggggtttcaccgtgttagccaggatggtcttgatctcctgacctcgtgatctgcccacctcggcttcccaaagtgctggaattacaggcttgagccaccatgcctggcctgagttgtgagtttttaaatacattctagatatgaattctttgttagatatgtagtttatcaatatcttctcccagtctgttgcttgtcttttcatcttctcaacagggatttcaaagagcaaaggttgtttaattttgatgaaatcccatttggttattttttcttgtatggatcatgtctaagaactcacaagtcccaggtcctgaagattttctcccatgtgacctgctacaagtttcatagcattacgttttacatttaaatcaattgttcattttaagttaatttttgtataaagggtgaagttaagattgaggttcattctgtttgtttacctgttgtccgatttctcaagcatgttttgaaaagattattattcctccattaagttgttactgtttctgaacctttgaccaaaggtggttgggcaaatttgagcgtctttttgggttctttgttctgtttctttaatctgtctttctgccataccacacaggactattgctatatactaagttttgaagtcatgtagagtaactttacctacgttattattttgcaaagtagttttagctattgtagtatacttggctgtctatacaatttttagaatagttttgtctatgtgtatatatatctgttgggattttatttatttttttatcttttgattttttaaattatactttaagttttggggtacatgtgcacaatgtgcaggtttgttacatatgtatacatgtgccatgttggtgtgctgcacccattaactcgtcatttacattgggtatatctcctaatgctttccatcgtccctccccctaccccacaacagtccccggtgtgtgatgttccccttcctgtgtccaagtgttctcattgttcaattcccatctatgagtgacaacatgtggtgtttggttttttgtccttgcgatagtttgctgagaatgatggtttacagcttcatccatgtccctacaaaggacatgaactcatccttttttatggctacataatattccatgatgtatatgtgccacattttcttaatccagtctgtcattgatggacatttgggttggttccaagtctttgctattgtgaatagtgccgcaataaacatatgtgggcatgtgtctttataacaacatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcatctgttgtttcctgacatgttaatgattgccattctaactggtgtgagatggtatctcattgtggttttgatttgcatttctctgatggccagtgatgatgaacattttttcatgtgtctgttggctgcataaatgtcttcttttcagaagtgtctgttcatatccttcaccctctttttgatggggttttttttttcttgtaaaaaaaattttgtttaagttctttgtagattctggatattagtcctttgtcagatgagtagattgcaaaaattttctcccattctataggttgcctgttcactctgatggtagtctcttttgctgtgcagaagttctttagtttaattagatcccatttgtcaattttggtttttgttgccattgcttttcgtgttttaaacatgaagtccttgcccatgcctatgtcctgaatggtattgcctaggttttctcctagggtttttatggttttgggtctaacatgtaagtctttaatccaccttgaattaattttcatataaggtgtaaggaagggatccagtttcagttttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtgccatgctgttttagttgctgtagccttgtagtatagtttgaagtcaggtagcatgatgcttccagttttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccattatttgtatcctcttctatttcattgagcagtggtttgtagttctccttgaagaggtccttcacgtcccttgtaagttggattcctaggtattttattctctttgaagcaattgtgaatggaagttcactcatgatttggctctctgttattggtgtataagaatgcttgtgatttttgcacattgattctgtacctgagactttgctgaagttgcttatcagcttaaggagattttgggctgagacaatgggattttcgaaatatacaatcatgtcatctgcaaacagggacaatttgacttcctcttttcctaattgaataccctttatttctttctcctgcctgattgccctgcccagaacttccaacactatgttgaataggagtggtgggagagggcgtccctgtcttgcgccagtttttaaagggaatgcttccagtttttgtccattcagtatgatattggccatggggttatcataaagagtgcttattattttgagatatgacccatcaatacctaatttattgagagtttttagcatgaagggctgttgaattttgtcaaaggccttttctgcatctattgagataatcatgtggtttttgtctttggttctgtttatatgctggattacgtttattgatttgtgtatgttgaaccagccttgcatcccagggatgaagcccagttgatcatggtggataagctttttgatgtgctgctggattcagtatgcaagtattttattgaggatttttgcatcagtgttcatcagggatattggtctaaaattctctttttttgttgtgtctttgccaggctttggtatcaggatgatgctggcctcataaaatgagttagggaggattccctctttttcttttgactggaatagtttcagaaggaatggtatcagctcctccttgtacctctggtagaaatcggctgtgaatctgtctagtcctggactttttttggttggtaagctattaattattgcctcaatttcagagcctgttattggtctattcagggattcaacttcttcctggtttactcttgggagactgtatgtgtccaggaatttattcatttcttctagattttctagtttatttgcatagaggtgtttatagtattctctgatggtagtttgtatttctgtgggatcggtggtgatatcccctttatcattttttattgcgtctatttgatccttctctcttttcttctttattagtcttgctagcgctctattaactttgttgatcttttcaaaaaaccagctcctggagtcattgattttttgaagggttttttgtgtctctgtctccttcagttctgctctgatcttagttatttcttgccttctgctagcttttgaatgtgtttgctcttgcttccctagttcttttaattgtgatgttagggtgtcaattttggatctttcctgctttctcttgtgggcatttagtgctataaatttccctctacacactgctttaaatgtgtcccagagatactgctatgttgtgtctttgttcttgttggtttcaaagaacatctttatttctgccttcatttcgttatgtacccagtagtcattcaggagcaggttgttcagtttccatgtagttgagcagttttgagcgagtttcttaatcctgagctctagtttgattgcactgtggtcttagagacagtttgttacaatttctgttcttttacatttgctgaggagagctttacttccaactatgtggtcaattttggaataagtgtgatgtggtgctgagaagaatgtatattctgttgatttggggtggagagttctgtagatgtctattaggtccgcttggtgcagagctgagttcagttcctggatatctttgttaactttctgtctcattgatctgtctaatgttgacagtggggtgttaaagtctctcattattattgtgtgggagtctaagtctctttgtaggtctctaaggacttgctttatgaatctgggtgctcttgtattgggtgcatatatatttaagatagttagctcttcttgttgaattgatccctttaccattatgtaatggccttctttgtctcttttgatctttgttggtttaaagtctgttttatccgagactaggattgcaactcctgccttttttttgttttccatttgcttggtagatcttcctccatccctgtattttgagcctatgtgtgtctgtgcatatgagatgggtctcctgaatatagcacactgatgagtcttgactctttatccaatttgccagtctgtgacttttaagtggagcatttagtccatttacatttaaggttaatattgttatgtgtgaatttgatcctgtcattatgatgttagctggttgttttgctcattagttgatgcagtttcttcctagcatcgatggtctttacaatttggcatgtttttgcagtggctggtacaagttgttcctttccatgttcagtgcttccttcaggcctcttttagggcaggcctggtggtgacaaaatctctcagcatttgcttgtctgtaaaggattttatttctccttcacttacgaagcttagtttggctggatatgaaattctgggttgaaaattctttctttaagaatgttgaatactggcccccactctcttctggcttgaagagtttctgctgagagatccactgttagtctgacgggtttccctttgtgggtaacccgacctttctctctggctacacttaacattttttccttcatttcaactttggtgaatctgacaattatgtgtcttggagttgctcttctcgaggagtatctttgtggcattctctgtatttcctgaatttgaatgttgacctgccttgctaggttggggaagttctctcctggataatatcctgcagagtgttttccaacttgattcaattctccccgtcactttcaggtacaccaatcagaatcttatcaatatcctcatctcccacatgaatattctctgacagttccagcccactctactctctcatcctttcctgaaatgttatggctcttatagcctgtgccacaaaattaggcatttaattttatattgtcttgttttgttttctaattatgtcatggatatattcttttccatgctagattgtgaattcttggcaaggaaccaattttcatgcttttctgtgtctcttttcagcatttagaaaatatggacatataattatactcaataaaaattgttaattgactgaacaactttcctaggttcattgtaactcttcagttctatgacattaaagtacagagcacaaaatggccaacaattcgtatgttaattatctgaaatgatgaaatcattcaatacacctgggcagctatgagaaatgtcgttgatggtgtgagcagtagtggtgcatgcaagggccatccatcctaaacagctctcatacactttgagttttggactgattcatcagttatctaccgagtagattgcttaaaaagaagtgttgggggctgggtgcagtggctagtgcttgtaatcccagcaatttgggaggccaaagcaggtggattgcctaaggtcaggagttcgagtccagtctggcaaacatggtgaaaccccatctctactaaaaacacaaaaaaattagctgggcgtgatggcatgagccagtcatccaagttacttgggaggctgagacaggggaatttcttgaaccagggaggtggaggttgcagtgacagtgagctgaaattgttgcactccaacctgggcaacagaatgagactctgtctcaaaaataaaataaaataaattaaataaataaaaattaaaattaaaaaaagtattgaggttttattgctccatttatttgtgttgtcatcaaccatttggtatccattgcctcgaagtaaatcaaggtgatctaaagggttaatttatgattcttggaaaattctataatgttcgcttatctcatttgaagaaaaagtaaaagttaaaatatttgaagaagttactactcagactataaaaatcatgtagtcttgccttctcattctattctcaaggttctggaagttaaataaaaatggcttattataatgctggtctttttactaactcataagaagttcaaaatatgtagtttttactcctctacctgctagtatttagataagcacctcaaaaccaatattcacgtttcataatcagagtgccctagttaaactccagatttgttacttactagctatgtgactctgagtaaatcatgtaatttctaagagccttcgttgtctttcagataaaataggcaaagccatatctacttctcagtgttcttgcaagaattaattagctcatataataaatgtgcttattactattcaaaaaacatataaaagcataaagagtacattactatttatctgggaataatcctttttattataatgtaataattgttattacaattattataaaactcatctttttgagtagggcatacattattgttcaaaatgtaataaaattggtgaagttttagaactggagcaagatgtcatagtagcgtaaaagagggcacttaacaagacctgggtgccagaaagtatatctaaattagaagatttttaatatgagttttagagattttaaggaagtcattatcagggcttctggagacaaggtggcttgggcacatttatattttagacatatctagcaggagggaacatggttgagcagagggtgatgatgacataaggacaccactgaaaggaatttgagtaaaatgatgacacatattaggagagatggggcagatattactcatttgagaaaaagccacacttcaagagtgactggaaagagtcagggagtgcgggaaaagagtcaaaggtgatccttaagtatctagtttgggtaactaggatagtgtggctccaacctgtcgtaatcagcttgggctgctataacaaacattatgctgagtggtgtaaacagtggaaatttatcttctcagaattctagaggctccaaagtctgagatcataaatgtcagcatggttggattctgttgagggccctcttcttgggttgcaggcagctgccttcttatatcctcatattctcagagagagagagagatcatctctcttgtgcctcttcttataagagcactaattccattcatgaggactctaccctcatgatctaactatctcccaaaggcccacctccaaatatactttggagattaggaacttaacatataaattttgggaagcacgacaattcaccccatagcatacccattgagaagaacaatacaagaaaatttggagttaactaatttgaggagaaaatgatgagtttacattaaatcaagacgaacttgagatgttttaagagggaactgcttcttccctactacttatatgttctgccaggaagagaaaattctgctagtgtggtacttctagtttcttctcttgtccctgtactcactctgcccctggggaggcgaattatttatttggttgttcaaactggggagagtgactcttctgtctagaaacagccttcctatggagagcctgggctgtcctctttcactccatgctttacatctgtaaattctgtaggagcctccctcttggaagccaaattgccccacaatccaggtcagattgtggttcatattagccactgcacttacccttgtttgaaagtcacgtgccccaacttggttatggcttggtctctatccttcctgcttatttttcagctttctcagtgttgaggcaggaatgaaaggtatcctttatagaaaggactctagagattccaacaaggccacttttgacaacacatctatgacccattttttggcatctcacacaattggctcatttaagtttttcaatgtttgagctaattaaaatataaatatgatgtatgttttatatacttccaaaatgtaataaatgctcagtaagtatctgtggagattatatatttaaaattagttgggaaacataactatcctactgttaaacattttttagagagatttagagatattcatttattgaactcctatttggctggtaatttgctcagtgtgacctgccatcctacactttttacaaactgccccacttctcattttgccaaaccagattgcctttctcttaatagctccttctttcttgccactgaacctaaactcatgttctgagcagtaggcaaaataattaacagacccacaaagatgttcttaagtcccagaccctgtgaatatgttatgttacatatcaagggggaattaaggctgtaaatggaattaaggttgctaatcagttgactggaatataaagagattattctggattatccaaatcagttcagtgtaaccataatggttcttataagtgaaaaagggaggcaggagagtcagagtcccagaaggatatgtgataccaggaagcagaggtcaaaatgatgcaactgctagatttgaacacggaagcacccacaagccaagtgatggggatggcctctagaagctgtgaaaggcaaggaaacagactctccttctagaaaagaatgcacattgatgacatctgattttagcttagtgaaacccatttcatatttctgaactgcaaaactgaaagatagtaaatttgtgctgttttaagccacgaggtttgtggcaatttgttgcagcagtaacaggaaacaaatacattctgcaactcatctcctgcattttccctgagtggccatttataaatacatagactctgacccagcctggccagagataaatcaggctcctccacctctccaactgctagctctgtgatcccaggcaagttattaaatttttacatgactatttcctcacctataatatggggattatcatgacaccatccttatagggatgagttaatagatgcaaagtcctttggaaaagtgggcacataacaaacactatagaagtgtacgctaatattttcattattatgcttacctctacaaattattttataaatcagttcaaacgccaattcttctatttccttttggaacaataagatctttcttccttaaatttatagagtactttaccttaacaatattttatagcatgtgttcgttattatgcttacctttacaaattattttataaatcagttcaaatgccaattcttctatttcctttttgaacaataaatttacagagtactttaccttaacaatgttttatagcatgtgatattttaattcttatttaatcactttcatacatattgaatcctctctcctaagatataagatcttgtaaaaattagtgatatgcattttatatatttactttatttattctaattttgttattcctatactgtctaggccagtgttttgcatatcataggtgttcaataaacatatttgaactaccaatggtgttttccacttgtgctaatttcaagaaacaaacaaaatcattcactattcaatgggcaacactctacagaaagaattaataaaacagaagaatgaataaaaacccgaagagtagcatgaagtctatagaaaatatcctccacaagtatgtagtgggattcagattctttttttcactttcactctagatgttcaactttaatttaaataacatgttagatcaagtgtgcttttataaattagttattagcccataaactgtcttatatagtctgctctgaaggttatcactttaagaggcatgatatactgtggggactgaattttagtactgtgcaaagacctgattggaatgaacatttctgaacttctagagcctctccagtaagaatgcagttgttgctgtgaaattgactttaaaagaagcttctgatgacaaggcctagctgattattgtttcagagatgaagtgaaaaaagagcaaacatagttaccatagaaataaatgtattaagttctaaaattaacattcttattagtgattatgcccatatttttttgatacatctacagttaatctcaaaactttcatcatgggtatggggttatacttcctggtatgacccaagatgtgaaactcaattaaggtcaaatgtcattaacttcggtagtatgttttaaaattaacctcaaaacggccccaaattttgttaaaactatagaagaagaaattatttattaagaaggtaagaaaagtaattcttctaaactatgcaatcatttatttattggctctgataagaataacatttcaaatggttgtgttttctgtcagtaatttgaagttctagtataatatttttatttaattacatgattacaaaacaagtctttacttacatcatatgcattatatgccaaattaattctcctttgaaaaggccaattgctgataagagcaatgaattctattgaatagctcactgaattctgagagagtaattaagaaatttttatatacacacagaaacacatgtggctcacacattaagatgtagacgacaatctttcaagataccatctaacaaatggaggaaatatgttttcagcttgcaaacttcaaagctctatgtccaataatgagataaatcttcatttctgatggtactaatccaacactgaaaaattaattctcctttgaaaaggctaattgctgatgatttcgcagaaaagaggtctattctttttagtggatatgaattgatcctgctaatgcagaacctgactttttcagattcctttagcctttagtatgagtgaatttttaaaatttctcttttgttgtgttagaaataaatataatgattttttctcatgctgatttttaagagtttaaaggaaaacaacagctgatagctcattaaggctcatgagacaccactaagcatatacaactcccattttgaggctgcataagccaaacactttcaattccactagaaggtgtcattagaagtacttaagcaaagaaagctactaggagcaagaacaccccagagaatttctgtaaagactttgatgcacccattgtcccatagtttaaaatgttgtatcactcaagcagcaacctcattaacagatcatttagattatcatgagttatgatgaactcaagcctctgtagtattttcttcccaacaatttgctttattacagcaatataacagacatctgccttaaagagaagtcttactttccactctattggatgccactgaaatttacagtgtctggggcaggaggaagaagtaataaagtcttacagggaaaaaaaaaacttgttacctaagggcaatatcagaaatgatgagaaatgagataagccagtaggactaattcaactagaactgaagaagctggctctgaatctgatttgctctcctccaaaagaaaaatatgctcatgataacaataactaatgtgtacttaatacttttgaggaaaatgactatgtggtgctccaaactatgtgcaacattctgtgccaggttattctatctatctatctatctatctatctatctatctatctatctatctaaaatttatgtatacacagaaatataacattttacataagtagtaaagtaactctgtattttaggtcttatcattgccatgttaaatatatttccagagtaatatagtcagtaagttgtttaagtggggtttggatgcaggtctctttggtttcaaaggctgcagtctttacccctcatcatattgccttgcttttgttgccttcttcacttcttttgtctctgtttcttattcagacaaaggtgggaattgactgtaggtgaagactcttctttggctaattggtttattttatccctaaggaagattcctattcttgcttctggtctctcttctccctctctctcttcctctctcttttttttctctccctctttccttccccctcctcagaaaatgactagactttacctttgcaatagactaaatcatagcccctaaaagagatatgcctaggtactaatccctgggagcttatccataaaaaatgtatttgcacacctgatgaaattaaggatcttcaaaggaggttcttgcattggattatccaagtggaccctaggtgaagtcacatgtatccctttaaaagggagggagatctctgtctccctctgggcttctcagtctagagggaggcagatacacacaagagaagaggcaatgagatcactgagtcagagattggagttaggcatccataaaccaaggcattcctggaattaccagaagctggaaggcaaggaatggattgtctcctaaagccattaaaaggaatgtgaccctattggcacctttaattctggcttctggccttcctaactgaagagataataaatatctattgtgttaagccaacaagtttgtggtagtttcttacaatagtcacaggaaactagcacaactctcttctttgaaattctggaattggcggcaggggaaattgcatgtaaaagcactgcatgtttacctctggctctgtgaaatcacaggaagtacagttaaattctaggaaacacaggggcatttttacctctgcacaaatctataaagctcctgagggtcctgcagtctttttccaccctgatgtctcccaagacagccttctgattgctgagatatagcctacattgaatagatatttgttgagcaaatcaacctgcttctgctgtggctccagcaggactggaacatttcaggaaagaataaaaggtcatttctcctgagttaagtgttaattcttgctttgaatgtcagtggcgtgctaacacctgctctcacatgtattttaggtccatcagcgtatcctaactagaaggccttgtgactagcagaaaagaaaatgtaggtgagccatgcaatgatggacgtggactgctctcagggcgcagtgacaattatgacttagtcatcaaaggtgaattgatacaaacacttgaacatatcttaaattagattgttccaggaatccttaaaatgcaagagaaatggcaatgatggggcagtggataaatctaaatgacattacgtgggctatgattcctttctccatgccatttggaaagttagaagaaatcatattaggcctgagaatagactgggtgcttctcagtgtgtatcctttacacccagagtgccaatcatctaggatgcaccggttctgccatactggggatatacagtcaaagtccattcttactagctggtaccttgcaggaccagttgtcaaatatttttaacagcaccttattcatgcatttttttctagaatatatatgaactttttccatccccagtattgtggctcccctcccatccctatttagatcctcatctctcacttggatgcctaaaatagccacttcagcccctctttctacataatcatctcctgtaatttattctcaacacatgttttcttgaagccttatccaaatatatgattcctctactaaatgcatgaatacataaagaaaacaaacatagaataatttactgctactgacttcatgtcattccacaggattaaatatagatcccatattatacacactcatattacacttatataatatctatattattatatatctacattaaatacacatatattctatacattaaaagaccctcacaatttgaaccacattgtatggactcaatgtttgtgccccacccccaaattaatatgctgaagcctaaaccccaatatgatggtatgtggaggtgggatctttgggaggtaattaggtcacaacggaggagctcttatgaatagaattaaagctcttataaaaagagacacaagagagattctctctctctctgccagttggccatatgaggatacatgcagctatcggcaaaccagaaaggccctcattgaaaacccaatcatattggcaccccgatctcacacttccaggcaccaaacctgtgagaaataaatgttggttgttgaagtcattcagtctatatagtattctgttattgcagcctgagctgactaagacacccatctaactctgcagccttctgttcctctctctatactgaagtctatttcattatttcatatgtatttctcatggctttttgaaatcaccagacaatttcctgcctccatggttttagagctgatgtcaaatgggaacaccctggtgacaccaagccaacagatgtcaattctggttggtcaaggctgctgctctatctgattagttggtttgggttaccctaaaggcagatcctgagacaaggaatttcatataaatagtttactaaagacataatctcaggaaggaggagtgagaaaagcatagagactgatacaaggatggaggaaagccaatataaatgtattttgacaaagttactgtgagaaatcagaagttcacacgtatgctaggacatgtgagaagcccacctatgaaatgaccttataatcatccagaaagataaggcatctatccttccatcattggttaggtttgttaactccactgcatttccaggttatactgatgaacaagatgagggaattccaaccacatcactccaggccaggaggctgaatcagaaagataagtaatcgtccatttcctctgctccctcactgtggactggaacgtggatatggtggtggggagccaggttccgtcatgtagatatagtggagcaaaaaagctctaaaaatctggatccctgcatgacctcatggaacagagtagttgtatttttttcatcctaccacccctggagtgcctaacgattctatattgtcaagtgaaaattatttcagtctcattctggtggctaaacccaaatcttaattaatattattctctcatgcatctgtcccatgctgtttactttcactgcactctagttccacttcctgtcagactctattgcaattatctatttaaatgcccatctccatcgttgcattgaaagttcttgatgacagccacggtgccatttctgaaccctgagtgcctggtaggtattggatttacaagaatttttaaataaaatttaaaatgtaattgctccaacagtaaagctgtaatacatgcaattaaaaatatatgatacataatcaccactcactgggctgcttactgtactttttctcatgaagtataatttgacacaggaaggttaatgaagcatttcctgggaaacatactttacatataacatgactccaagatgtgtttgtaccattcttgtattctttccctctgtcacaattagagaggtggttcttctcctagccaagaaaaattcttctatctatgctatagatcttcttttttctcctaccattaagaccctaagctcttttttcgattccttcaagttctttctctctgttggttaaaatctctctaaaacaatcaaagaatgctacctagtcttcacatgttcctttaagtggcagactcttttctttccctctttccctccctccgtccctcccttctttctccctctctttccctctttccctttccttctttctttctttctccctccctcccttccttttccttcctctctctctctctttctttcttttttttttttttgagtcttgctctgtcacccaggctgaagtgcagtggcacgatctcggctcactgcaacctccacctccctgattcaagtgattctcctgctttggcctcccgagtagctggcattacaggcatgcaccaccactgctgggtaatgtgtgtgtgtgtgtgtgtgtgtgtgtgtgtgtgtgtgtgtgtgttttgagacagagtcttgctctgccacccaggctggagttcagtggcatgatctcagctcactgcaacctccacctcttcagttcaagtgattctcctgcctcagcctcccaagtagctggaactacagccatgtgccaccacacctggctaattttttgcatttttagtacagatggggtttcaccgtgttagccaggatagtctcaatcttcctgacctcatgatctgcccacctcagactcacaaagtgctgggattataatttttgtgtttttagtagacatggggtttcatcatgttggcccagttggtctggaactcctgacctcaggtgacccacctgcctcggcctcccaaagtgatgggattacaggcgtgagccactgcacctggccaggtgacagactcttaattatcctgtgggagtcaaggtttcataaaagccttcacttgctgtctgcattttctcactcacttcacaacacaattccaacacaaccaggtttatatcgctcttgccaacatttcacaaaattcaatggacttctgttatcatacatatctgtcagcagcactcaacaccactcaatcctcccttcaaatgtccactgtgtcttcatttctgtttattcttcttttctctccagccactcattctgaatgtattttgctgcctcttattccctcagtagacatttaatgataaaaattctcaacatttatttcaagatacgcttcccttctcactcaatataatgtcgctacttatttttttccaattctatggcttcattggtcatgccacaaatcctaaatgttcatcgcctggacagaccttgcttctgagttccaaaaatgtctattcaaatgtgtactgagatgtctcactggcaactcaaaaccatatgccattgtatctgaaatgttggcccccttcaagactctcaaccaagaaattgcaccataatttacctcattgttgaagccaagaaaatggaaatcttatatgatttctcattctgccaccaagaatggccaaccacactgaattgcctggaactgaggcgtcttgtgggaggtagaacttttaaagctaaaattaagttagttggttaccttccaatctggctcctggctctgtgcattctatttcctaaatatctcttatatttgttcaattatttccattttcatgacctctgctactgtctcttgtacagggatccgtacgttcattcttgcccttcatttctcaccctacaaatgctttctgtacacaatgaccacaagatatcaacaaaaagcaaaacttatgatatcaatctcttccatccttctcattgtctatgagataagacccagcaatatctgggccctgcgtgtctcctcagactcatgattcattatttcctctgtgttccagcccaactaacctttccatttcttaaatgtgccatgaaacaggcctggaattactcttccctactccttcttcctattaactcctcatcttttgggtctcagaatcaatgtaatttcctaaagatgttttgccttctctccctagacaagatcagacacatctttttccccccgcccatatcaaactgcactgttccttcacagaattcaacagcattcattatttgttcaatatccatcttcccagccacactagaaactccatgaagcaactattattgctttattctcttaccactgtatatacaataccccaatcagtgcctagaagcaaaaaacttttgtgaaatgaataaatattttgttatagaatatttccttatgtgatatcatgtcctattataacttcagataggttaactaaaaatataactctattaaggaaagaaataaggccatggcccctcctaaaattttagcaagttttaccatatcccctttgtatggtttggatttgtgtccctgcccaaatcttggattgtattctccaatgttggagtaggggcctggtgggaggtaattagatcatgggggtggacttcccccttgctgttctcatgatagtgagtgagttctcacaagatctggttctttaaaagtgtttagcacctccctctttgctctcttcctccttctctggccgtgtaagatgtgtctgcttctcttgcaccttccaccacgattgtaaatttcctgaggcctccacagccaggcttcctgcacagcttgtaaaactgtgagtcaattaaaactcttttatttataaattatccagtctcaggttgttctttacagcaatgtgagaatgaactaatacagcactgaatctaagatgtcatcaatggtaacgtgtcattattttaagtataactaagaaagaaaaacaatgttgaaaaataagtcatgaaacaccttgactgaaagacacatccagttttcagatatcaaaaagtaaaaaactgggaaaggccacaacttccacaacaaatcttgtttgctcacttctctctctactgggtggtccctccttggtccatggagtatcacctcattcttgggccattgcaacttccttgtattctcctaactagtatcttctcttgtatacttgaacccccagcttctttacatttcaaccagactgatcatttcacaatacaaacctgatcaccccaaaatgcaaagcctgatctctggataaccctatactggttgtctattctatgacacatcacacacatactctcccttgttttctgtcttcctgacatggttcctaaaatatgccagcttctttcctttatctggaatattctgcgacttgctgtcttcaatcgttccttctgctccttttcattttatagtgttcattacaaatttccccttcccagaacgatgttctgtgattctgtcactgcaaatcagtagcccctctcccctgcccatgccgttagaatttttcacacgtatagcctgttctcttccctcaccgagctcatctcaagttctcattacacatatttttttgtgtgtttatttgcataacgactgttgcttccactgaactttgagctccataagggtaactatcagcatgatgtgccagtgccatataccacagtgtgacacagatagattatttattgaatgaatgaggaagtggaacagttacactttgctgaaacaaagacaatagaaaattcaatgcacagccctgagaggaatctagaaacaagtctgcagctaaaaagaagcagcatatacccccaaaacttaggtaggtgtcataaccacatcctcataaccatgtgtgttctcaccagatacacctgccttctaaagactgtttaaaaacaattcacactaaaggtactacttaagaaaaataggcccttccatcttaaaagagaaaagtttttatgtattgcattgtatgttcctctcaaatattttaaaattattttaagtcacagattgtttcataaacataattttgtttttccaataaaaagctttgaaaaaactcagaaaatatttttgcaaatgtggacctcaatatcatttgttatgtctcattttgaaaaataatcaaatttgaaataaaatgtgttttagaaggttagaaatatacacatattttctcttcacacgtttgtgaaaaaaattaggtaaatgactaatgagaaaatactactagactaaatttacaaagaatacagagcaaaaacagaacaatcttaatagaatcagtgccaattacatctcacatttcaatggcagtgaaaataaatgtgattttgacatatgaaattgtgttaggaatgtttttatgtagaggaaaatgttatcatccttgggggctttttgttcaaccaattttcaactttctaatgcctggctgtgccttgtgtggaatcagggaagtcactatttctctgtccttgaatactgctcatgcatcattctcataaaaatatatatttgcccatccctgaattcatgtgtctcttcattcactcagcatttatggagaaaattttatatgacaagcacttggctagcttctgtatatacaaagatgaataattctaggattaaaatatggcaggaaaaataaaaccattaacaagtaaattctgaaagttaaatgctaataaaaaagcagtagacatatgtacaaatattgaatgccattttatatctctcttcattttccagagaagggcattaaggcttaagataacaaggtaatttcatggagatttcatacctaacgaatgaaaagactagggcttgaattctggtttctcatttcataactagtaaatccctttaccgagtgttgtcaaacatatgtcatccattttatgtatgaaatctcctttcatactatgcatcttcaccagtttgagctgctataacaaaataccatagactgggtaccttataaacaacagaaatttatttctcacagctctggaggctggaagtccaaaatctgtgccagcatggtcaggttccagtgagagccctatttcatgtcacagactgctgacttctcattatatcctcacatgaggaaagagcaagagaactctgtggagttccttttataaagacaccaatccattcatgagcactccaccctcaagacctgattacctcctacagaccccacctcctagtattatcacattgaaggtttgatttcaacatacgcattttgaggggaaaccaacattcagtccataagaccatgaaaaataacaatttttatttctgttatactgacaaggaaaccaagactcagataggctcagcaactggccaagccacacagttagtaaatggcagcaccaaaattcaaactcaagtttgtccaacccagaaacttctgcaatgtctactatcacgagcttcctctctattccagttcccatgtatctgtgaaatgatttaattatcacacattactagcatttgttgagcatttatatgtcccaagcattccttaaagatgcttccaagaatcaagttatttaattccaaaaaaaataatatgtaggtactgaggtaccatcctaaggtattgaggtattatcctgatagcacaccgagaatgctatcgggtctcccaaagatggagaattaaagaacgaatgtctctatattcctcagcaggagtcagtctaaaaggaataatccaccagccagagtatatgccatttttagattacagatacaatccactataagttccaaacccagagtggtcaatattgcttttcttcttttatatctgttctgttttgcaaaatatatgttatggttaaagaatgaacttgagtgagctgccctgaaatgagagccatttgtttaaagttctgtggtgactccttcttccttcccacctgcatccccaaccacatgttgagattcctggaaatatgctccttcataagggtagagagccaatgaggaccaaatgatatgttttcctttccctcagcttcaagggctcaaagtcccagatgaggggcagggagcatactccatgacagaaataaacaaacagccaggtggcccaagtaatgactagccaggtctctggaaactcctcaagaactcaccggcttgcagcctaatctgggaacagtgttgtacatgactacatataatataatgtgaatagtactactacagacaggtggaccaacatgatctgaaagcaccagttaagaacacatacagaagtatttgatacaaggtaaaatctatcattcaaaggcatacaagtactttgcaactacgaaacacctctaaaaaactaacggctttgagacagtgctatacataaagataaataatttaaaagactatatgtacattctcaaaagtttgtccttgcacaaatcacttgcttcccaccataaacacttctgagacccttcctaataaaaccattaaggttgagcaggcaacattgtttagaagaacaactgtgagttgtacatgacccttcataaaagcagagactactaaacatcattagtaggcgatattacagcatcttcaaacccagacataactggcaccaaatttgcaggaaaatgagttaccttcctaatagcccttaattacaattacaatgtgactttactcgtattccagtaatgaaagcatttactctcattcctcatctgatttaaagggcaacataagctgaatgcaagataccttataaaattagaaaagcaattgaacaaactttaacactgtgccccaggatgacaagaaggaaacttcttcagaaacaagacatcagtgtatccaaaaagttctttggatttcacagtttgtaatcccagggaaagaaatatggaaaaaaaaattgagaactcagttatttggccaagctaaatcaaacacatgtttataaatctaatttctatttcttagagataccgagttacagatactatatgggctaatgataacgaagatgacaaaacttctttttagtaaaaaataaccattagctataaaaattagaaaatagagaccagtgaaatataaattgagaatagggtataatggatattacaacaattaaaagaaaaaaagctggccaggcacgttggctgacgcctgtaatcctagcactttgggaggccacggcgggaggatcacaaggtgaggagatcgagaccatcctgactaacacggttaaaccccatctctactaaaaatacaaaaaattagccaggcgtggtggcgggcgcctgtagtcccagctactcaggaggctgaggcaggagaatggggtgaacccgggaggcagagcttgcagtgagccaagatcacgccactgtactccagcctgggcgacagagcaagactccgtctcaaaaaaaaaagaaaaaagcttattaaataatttaatttagtgctataccttataaaacattgtaaaagaaattccaaatcaaaatgttatttaaaaacaataaataacccctctagttcaaaacagaactaaatatttatgaactttttagaggaatagtgcttttctgcatcaaagaagtgacaacaaaggtagtggcagattcaacacagaaaaattacaacttcctcatacaatgaaaattttacctaaagcaaagaagggattaacatctaatatgacaaaatgttaagatctgaattgtacacaaagtgcacagaaattgataaggagaagctctggtgacggctagaagattgccagagatgtgaaccatgtgtgggaaagctcgactgggaggataatataaaacaagaggaaagaaaagtcagatttagagtgagaacattgtcaataagaattgccagggtcccctagatggttccaatgagcctcgtctcctgataatcacatccttgtgggagggggtctcacattgacttgtgtaaccaatatgttactgcagaaatgaagttatatgacttctgaggctaggttaggaaagattttgcaacttctgccgtgtcttttcttgtatcacttgctctggggaaaggcagctgccacattgtgaggaaactcaagcagccctatggagaggtcaatataaaaataactgaaacattctgagaactgaagcctacatctacttgattattgtacaaaggaagaaattgaggcacagagattaagagccttgcccaagtttacacaggaaggaagtgccagatctaagatcaggtttccagagcctgagtccttaacctttacatgatactgccttctccatggtagaaatagaatgaaaaaatgtttacaattgtatgaaacataacaacaaaaaagaaatgctaaaattcagaaactgattggatgtgaaggcaaggggtgcattgaaatggctttagtttttcaaatatggataacaaggagaacagtagggttattaattaagataaagatcagacactcacagtttgaaaagtaaaatgtgcacataaatgtatgcatgtgtgatcattcatgttgtttagagagtaaagtgatacacagggaatgtagtgagcaagctggtttgggattatcagatttgagcttgcccaggcaagaagaatttcagagaagcttcattccactagcatatattaaaagatggcctctttcaaatgataatgtgtatactactttccttctggagattcataaaacgttggaaatttcctcactccacttaacctcttttttgcccgtctcattcttatcagtcactctaggcatggatctaatctaaattatttttaaaatatgactctttaaaaacacatactaattaagtagaattcaataaaattagtttatttaaaacatgaatgaaataaaaataattagactcgttttgcaataactagaatataaactactatgcagagtgcaaatgctatgtttcattagtgtgtaagagaatattctaagtttgagaagtgttttatttctctaaaattagaaaaattttagtttttctttagtttttcttctcccaaacatatgtgactttatttcattttaatatataagtctttttaataaatacatttctgtctatggggagctcggaaaaggcaggtgcagcaggtgttatttttgaagagttctgtacacgttcacatctgcttagttgttatgcactgctgcatgtaatggccaagaaaatccaacacaaatgctgaaaccaaaatccccaggaaaccagcagaaacgaaattggacaaatcctaatacataatgtatatacttcaatatcctattgcatgtggttacaaatttgaatatggcatatagcttatctttgtattttactaaaataaaactaaaacccacaaactatctggggagattaaatttaccgtacataaaaatgcccaagggaatgctgcattccttttatgatagagggactaggcaatgaccagagcggtgcaattaaccagactgttggtcatgagttgatattattgttccactagccccacttgattcactgccaagctcatcccataccctcatttgttagagccactccatctttgctctatttcacttgcatagaaaaaaaattcagatcctgaaaatcaatatgttgttgaattctaattttgtcttattttacttgcagatcttatctcacttgcagctgtttacattttccatattgtgttaatagtcaaattttatttctaaacataacctaatttttgctgtgcaggtaacaggctgtttaacaagctatacctactttagggtccttcagtttttttattctgtttgactatgtaatgtcttcatcaaatatctcctcatttgaacatcaaaaatattattttttattatagcaaccaccaagtatcatgatacaaagcactaaagttggttcttcgagaattattttgaaaatagctcttttaaatgtagaaaataaatttccttgtgtttcttattttatatactaaatatattcatttacaatatatatttggttttcacttcatatgttcttgcctcctttgaataattttaatttaaagagaagacacaatttccaaatgtttaataaagcctcttagaattatacttcatgcaatagataaatagctatgatacctgatcagaaaatctcatgagcagtaatgactgaggagggctcctgaaggatgctatgtctccgtatccttccacttccccaaatatacaattaatttaaagctggacagacaatgggacaaagtttcagccattaaactccaaatccctcaaaatttaaaaacaaaaaaatttatcaacaaaacaaatagcacattttaaaatttaaaactaacttaatatatgactatacaacccaccaattccatttctagctatcttccccaaagaaatgaaaacatacattcacaccaagacatgtacagagatgttcatagcaactttattcacaatagccaaaaagtggaaacaggccaaatgtccatcagtgagtgaatggataaacaaaatgtgtcatagccatacaacagaacattactcggcagttataaaaaaggacaaagatacatactataacattagtgaaactcaatcatgttatgcttggtgaaagaagccagacacaaaagaccacatacaaagatatcattttttattttgtttcattttattgtgccttgcagataccacattttttttacaaactaaagatttttggcaaccctgcatggagcaagtctataggagtcaatgggagtcattctgaacagcatgtgctcatttaaagtctcagtgtcacattttggtaattattacaatatttacaactttttcactattattacatctgtcttggtgatctgcgatcagtgatctttgatgtggctaccatcattgtttggggcaccataaaccacactcagataacatgttgaacttaataataaatgtgtgtgtgtgttgactgctccacagaccagacattctccatctctctccctctcccccagcttccatattccctgagaaaaaacattattgaaattagaccaattaataatgctacaatggcctgtaaatgtttaagggcaaggaagaaccacccgtcttttagtttaaatcaaatgctagaaatggttaagtttagtaaggaatgcatactgaaagccaagataggccaaaagctaggactcttgggccaaacaggtagccaagttgtgaatgcaaaggaagagttcttgaagaaaattaaaagtgctactccagcaaatacaccaatgataagaaactgaaacaatcttattgctgatataaaggaagttttagggctctgggtaaaagttcaaactagccacgatattcccttaagccaaagtcaaatccagaataaagtgactttcttcacttctatgaaggctaagagaaacaaggaagctacagaagaaaagtttgaagctaacagtggttgattaaggaaagaagttgtctccataatataagaagcagcaaatgctgatgtagaagttgtagcaagttacccagaagatctagctaagaaaattgatggagggggctgcattaaataatagattttcaaggtagaccaaatggtcttttattggaagaaaatgttatctaggactttcatagctgtggagaagtcaatgtctggcttcaaagtttcaaagtacaggttgactcctttgttaggggctaatacagctggtgactttaaattgaagccgatactcatttaccatttgagaaatcctagtgtccctaagaattatgctaaacttactgtgtttgtcctgtttcccataggtgcaacaacaaagcctgaataacagtacatctgtttacaatgtgacttactgaatatgttaagcctgctgttgggaactactgttcagaaaaaaaaagattcttttcaaaatattactgcttatggacaatacacctggtcattcaagagctctgatgaaaacatataaggagattaatgttgttttcacacctgctaacacagcatccattctgtagctcatggatcaatgaataattttgattttctcatgtaattatttaatacaaggacagacacttctcaaaagaagacatttatgtggccaacaaacatatgaaaaaaagctcaacatcactgatcattagagaaatgcaaatcaaaaccacaatgagataccatttaacatcagtcagaatggcaattattaaaaagtcaaaaaccaacagacactgacgaggctgcagagaaaaaggaacgcttttgcactattggtgggagtgtaaattacttcagccattgtggaagacagtgtggtaaatcctcaaagatctagacgcagaaatatcatttgactcagcaatcccatcactgggtatatgcccaaagaaatataaatcattctattataaaaatacatgcacacacatgttaattgcagcactattcacaatagcaaagacatgaaatcaacccaaatgtccatcaatgatagactgaataaagaaaatgtggtacatataaaccatggaatactatgcagccataaaaatgaataagatcatgccctttgcacggatggagctggaagatgttatcctcagcaaactaatgcaggaacagaaaaccaaacaccgcatgttctcacttttatgtgggagctgaatgatgagaacacatggacacatcggggggaacaacacacactggggcttgtcaaggaggtgggggaagggagaacatcaggaaaaatagctaatggatgctgagcttaatacctaggtgatgggttgatctgtgcagcaaaccaacatggcacacgtttacctatgtaacaaacccacatatcccgcacatataccatggaacttaaaaaagttgaggggaacaaaagaaaaaagaaagaaataaatttcttaatgttatagctgccatgaaaagtgagtcctctgatggatctgggaaaagtaaactgaaaatcttctggaaaggattcaccattctagatccaattaagaatgttcataattcatgggagaaggtcaaaataacactaattggagtttggaagatgttgattccaacccttgtgaatgactttgaagggttcaatagtttagtggaggaaggaactgcaaatgtggtagaaataacaagagaactagaattagaagtcgagcctgaatatgtgactgaatatgttactgagtttgatcaatctcatgatcaaactacaatggatgagaagtttcttcttctggatgagcaagaaaattgccttcttgagatggaatctacctctggtgaagatgcagcaaacattgttgaagtgactacaaaggattttgaatattacacaaacttcgataaagcagaagaagggttttgagagtcgactccaattttaaaagttctattgcaagtaaaatgttatcagacagcattgcatgcaacggaaaaatcttttgggaaagagtcagtggggaaacaaatttcactgtggttttaagaaattgccacagccttggctgggcacggtggctcacacctataatcccagcactttgggaggccaagccgggcagattacttgaggtcaggagttcaagaccagcctggctaacatggtgaaactctgtctctatcaaaaaatacaaaaaattagcagggcgtgctggtatgtacctgtagacccagttacttgggagactgaggtgggagaatcacttgaacctgggaggcagaggttgcagtgagccgagattgcactactgcatttcagcctgggtgacagagtgagatgctgtctcaaaaaaataaataaataaaaataaattgccacagccacacaaccttcagcaaccatccctgatcagccagcagccatccacactgagatcaggccctccattagcaaaaagattatgacttgctgaaggctcagatgatcatcagcatttttttggcaatcaagtattttaaaaattaaggtgtgtacattgtttttttagacataatactattgcatatttaataggcaacaatatagtttaaacacaacttttaaatgcattgggaaaccaaaaacttcttgtgactatatttattgcagtcatcaggagctgaacctgcaatatgttcagttcaataggtatgttgttttgtatgattgtttgtgtgtgtatgtgaagaatctgtgtatttattgatttatcacctaaaaccttcttaaaattttatctattgagggggtacaagatttcttacatgcacatattgcgtagtggtgaagcctgggcttttagtaaacccattacctagacagtgaacattgtgcctaataagtaatttttcaaccctcatgcccctgccatcctcccacctactgaagtttccagtgtgtattattgcgctgtatatgtccatctgtacgcattgttcagctcccacttataagtgagaatatgtggtatttgacttgctgggttatttcacttaggataatggcctccaggtctctccatgttgcttgcaaaatacatgattccattcttttttatgcatgagtagtatttcatgttgcatataaattttatatatatatcatttctttatatataacaaaaatgtatataaatgcataaatatgtttgtgtgggtgtatacacacatacacacacaccacattttcttccattgatggacacttaggttgattccaaatctttgtgactgtgaatagtgctgcaataaacataagagtgcaagtatatattcttttatttatataaaatatccaaagaagggcagatatgtagagacagaaagcagatgagtggttgcatagtggtggagagtgtcaatgggagtgactatatgcacatgagatttcttttgaagctgatgaaaatgttctattattagtgtgcggtaagagctagataaattatacacttaaaacacgtgagctttatggtatataaattttattgcagtaaagctattaaaaacaaatggcatacactatcataaagctaatattactatgtttattgaaaacctattatctatagacaacacatgactcagattacagagggaacaggtcttaaacatagaaactatgatttaagtgtatgctgatctctaaatgactgacattagctcctttttttgagatgtttcatgggagaaaatgtatagaaagctaagagaggtggaaagatggagacacaaaagaagaggacagggtcaggaggcccaagtgtacctaaatcacaagaatgagcctggtgattcaccctgcaatcctttgcctttagagaccctcttggataggaattaggaagcatctccagaagggaaggtgacaaagacaatgtaatacgatgtaggttttttagtgattctctttcaactattgtgtctagtatttggaaaacattagaaaaaagttttagctatacatcattattttatatgttgtatttgctgatacagagattcaaatcagttgggtgactggtgatcagtagatgctcaataaatatttgtccaatagaagaatgaaagaacaattatgctatccataaattacaatattaaatatccatgagctatataattcaagggcaatggggcattggctgtgagagaaaattgtggaagaaaagcagatttgggatagggttagaagataatgaggccagccttggacataatgaacttaagcagagctcgtcccattgacatagaaccatctggaatgcatctcaatatatggttctggattgaggatataaattaggaagttttcagcatagctgaagtcatggaagtctgtgacatataaatcaataatgaatcaatttattttaattgatatacaaaatatttccatgtaattaattctgtctataattctgtattttttggctctgatggtaaatctgaataagtctattaaaatcttcagacattatacattttctttgagaacaacagtggctgtaaacaaagctgcctttgttggcttataaagaacatttgctgttcccacaaattacttttaatgatgcaaaagtccctctgtgacagagacttgttctgtggttatgcatttccctttctaatttcactttgtttcctttctggggtatactccttttgagacacccagagtctgaaaaatgtgagtcaaaccacagattggctggtaggaaaaaaagaaaatagttcatttcccctcttattaaatgtttattcttgttatatataaactcacttgctcttgctatgtggcattacaatattagttttactggtagggcttttaaaatactatcaatcaaatggggtgatagatatattatggggaacagaaccctgatttggagttaaaagaacttttatttaaataacagcttttccatttaccaactttgtgatcttgggtaaactgtaaggtttctctgagattcagtttcttgatccatcaaagttaagtaaatttatgtttctagtaggtttttcatgataattacatgacattatatatataacatatataatatataatataaaatatatataatatataatatacatataatatatataatatataagatatatatattttatatatatatctccaatatctaaatagactggttgctgactttatcattagttgatggttgacagaattatatacatttattttaattatatcattatttttcatatctaataaaaacttaaatcagtggagactttattcaaatatacttcccataaaattcaatgtagcgaagtttttggagcattttttactttattttattttattattattatactttaagttttagggtacatgtgcacaatgtgcaggttagttacatacgtatacatgtgccatgctagtgtgctgcaccaattaactcttcatttagcattaggtatatctcctaatgctatccctcccccctccccccaccacacaacaggccccagagtgtgatgttccccttcctgtgtccatgtgttctcattgttcaattcccacctatgagtgagaacatgcggtgtttggttttttgtccttgcgatagtttactgagaatgatgacttccaatttcatccatgtccctacgaaggacatgaactcatcattttttatggctgcatagtattccatggtgtacatgggccacattttcttaatccagtctatcattgttggacatttgggttggttccaagtctttgctattgtgaatagtgcctcaataaacatacatgtccttgtctctttatagcagcatgatttatagtcccttgggtatatgcccagtaatgggatggctgggtcaaatggtatttctagttctagatccctaaggaatcgccacactgtcttccacaatggttgaaatggttgaactagtttacagtcccaccaacagtataaaagtgttcctatttctccacatcctctccagcacctgttttttcctgacattttaatgatcgccattctaactggtgtgagatggtatctcattgtggttttgatttgcatttctctcatggccagtgatgatgaacattttttcatgtgtctgttggctgcacaaatgtcttcttttgagaagtgtctgttcatatccttcatccactttttgatggggttgtttgtttttttcttgtaaatttgtttaagttctttgtagattctggatattagccctttgtcagatgagtagattgcaaaaattttctcccattctataggttgcctgttcactctgatggtagtttcttttgctgtgcagaagctctttagtttaattagatcccatttgtcaattttggcttttgttgccattacttttggtgttttaaacatgaagtccttgcccatgtgtatgtcctgaatattattgcctatgttttcttctagggtttttatggttttagctctaacatataagtctttaatccacctttaattaatttttgtataaggtgtaaggaagggatccagtttcagctttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtaccatgctgttttagttgctgtagccttgtagtatagtctgaagtcaggtagcgtgatgcttccagctttgttcttttggcttaggattgacttggcaatgtggtctcttttttggttccatatgaaccttaaagtagtttttttccaattctgtgaagaaagtcattggtagcttgatggggatggcattgaatctataaattaccttgggcagtatggccattttcatgatattgattcttcctacccatgagcatggaatgttcttccatttctttgtatccttttttatttcattgagcagtggtttgcagttctccttgaagaggtccttcacgtcccttgtaagttggattcctaggtattttattctctttgaagcaattgtgaatgggaattcactcaggatttggctctctgtttgtctgttattggtgtataagaatgcttgtgatttttgcacatcaattttgtatcctgagatttgctgaagttgcttatcagctgaaggagattttgggctgagacaatggggttttctagatatacaatcatgtcatctgcaaacagggacaacttgacttcctcttttcctaattgaataccatttatttccttctcctgcctaattgccctggccagaacttccaacactatgttgaataggagtggtgggagagggtatccctgtcttgtgccagttttcaaatggaaggcttccagtttttgcccattcagtatgatattggctgtgggtttgtcatagatagctcttattattttgagatacgtcccatcaatacctaatttattgagagtttttagcatgaagggttgttgaattttgtccaaggccttttctgcatctattgagataatcatgtagtttttgtctttggttctgtttatatgctggattacatttattgatttgcatatattgaaccagccttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcctggctttggtatcaggatgacgctggcctcataaaatgagttagggaggattccctctttttctattgattggaatagtttcagaaggaatggtaccagttcctccttgtgcctctggtagaattcggctgtgaatccatctggtcctggactctttggttggtaagctattgattattgccacaatttcagagcctcttattgatctattcagagattcagcctcttcctcgtttagtcttgggaggagggtgtatgtgtcgaggaatttatccatttcttctagattttctagtttatttgcgtaaggatgtttgtagtattctctgatggtagtttgtatttctgtgggatcggtggtgatatcccctttatcattttttatcgcatctatttgattcttctctcttttattctttattagtcttgctagcagtctatcaattttgttgatcctttcacaaaaccagctcctggattcattaattttttgaagggttttttgtgtctctatttccttcaggtctgctctgattttagttatttcctgccttctgctagcgtttgaatgtgtttgctcttgcttttctagttcttttaattgtaacgttagggtgtcagttttggatctttcctgctttctcttgtgggcatttagtgctataaatttccctctacacactgctttgaatgtgtcccagagattctggtatgttgtgtcttttttctcgttggtgtcaaagaatatctttatttctgccttcatttcgttatgtacccagtagtcattcaggaacaggttgttcagtttccatgtagttgagcagttttgagtgagtttcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatcctttttaactttctgtctcattgatctgtctaatgttgacagtggggtgttaaagtctcccatttttattgtgtgggagtctaagtctctttgtaggtcactcaggacttgctttatgaatctgggtgctcctgtattgggtgcctctatatttaggatagttagctcttcttgttgaattgatccctttaccattatgtaatgaccttctttgtctcttttgatctttgctggtttaaagtctgttttatcagaaactaggattgcaacccctgccttttttttgttttccatttgctcggtagattttcctccatccttttattttgagcctatgtgtgtctctgcacatgagatgggtttcctgaatacagcacactgatgggtcttgactctttatccaatttgccagtctatgtcttttaattggagcatttagtccatttacatttaaagttaatattgttatgtatgaatttgatcctgtcattaagatgttagctggttattttgctcattagttgatgcagtttcttcctagcctcgacggtctttacaatttggcatgatgttgcagtggctggtaccagttgatcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttaaaaattctctcctttaaaaatgttgaatattgccccccactctcttctggcttgtagagtttctgccgagaaatctgctgttagtctgatgggcttccctttgtgggtaacccgaccctttctctctggctgcccttaacattttttccttcatttcaacttcagtgaatctgacaattatgtgtcttggagttgctcttcttgaggagtatctttgtggcgttctctgtatttcctgtatctgaatattggcctgccttgctagatttgggaagttctcctggataatatcctgcagagtgttttccaacttggttccattctccccgtcactttcaggtacaccaatcagacgtagatttggtcttttcacgtagtcccatatttcttggaggctttgctcgtttctttttattttttctctaaacttcccttctcgcttcatttcattcatttcatcttccatcactgataccctttcttccagttgatcgcatcggctcctgaggcttctgcattcttcacgtagttctcgagccttggctttcacctccatcagctcctttaagcacttctgtgtattggttattctagttatacattcgtctaaatttttttcaaagtttttaacttctttgcctttggtttgaatttcctcctgtagctcggagtagtttgatcatctgaagccatcttctctcaacttatcaaagtcattctccatccagctttgttccattgctggtgaggaactgcgttcctttggaggaggagaggcactctgctttttagagtttccagttcttctgctctgttttttccccatctttgtggttttatctacttttggtctttgatgatggtgatgtacagatgggtttttggtgtggatgtcctttctgtttgttggttttccttctgacagacaggaccctcagctgcaggtctgttggagttttctagaggtccactccagaccctgtttgcctgggtaacagcagtggtggctgcagaacagcggattttcgtgaaccacgaatgctgctgtctgatcattcctctggaagttttgtctcagaggagtacccagccgtgtgaggtgtcagtctgcccctactggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctaggcaatggcaggcgcccctcccccagcctcgctgctgccttgcagtttgatctcagactgctgtgctagcaatcagtgagactccttgggtgtaggaccctctgagccaggtgcgggatataatctcctggtgtgccgttttttaagcccgtcagaaaagcacagtattagggtgggagtgacccgattttccaggtgccgtctgtcacccctttctttgactaggaaagggaattccctgaccccttgcgcttcccgagtgaggcaatgcctggccctgctttggctcgcgcatggtgcgctgcacccactgtcctgcacccactgtctggcactccctagtgagacgaacctggtacctcagatggaaatgcagaaatcacccgtcttctgcatgactcacgctgggagctgtagaccggagctgttcctatttggccatcttggctgccctcccgtatatggagcattttgaaatataatttttcctaccatattctttgtgtatttcctctaattttcccttcttttgatcttagatgcttttagaaagtctctctttgcttacttgaaactactctttcctaaagtaagaaagaacttaaattttcaaagaaaaaatgtatatataaggtaaatagatattattgttcatactcctatattattatttgaaatacacaaatttgttgttagggatgacaccaagccttctgaaccctcatcaggtcttctagaacaattgcctgctctactattaactatgttgcttgagatcaaatatttaaccctttggtgccatctctaaagtaatcagattagaaattagatctccagcagtttataagttgttgcacttttttgaggattttagatttaggactttcattttaatgatacaaaataaacaattaaaagcatactctgcattgttaggatgaccacttgagtatgacctctgatttcaatgtttatgatcatgtaggtgggtttacttcacttgctagaggctaatgaggaaagaaaaaaacagacacatataaatgaagcttccacagcaaggagggccaaatggtgctgtggctcactagaccaatgagggttttgcagaaacttaaaagaaaaatactgagagaattaagttaacacataatctatgggagtcatcgtgtcaaacttgtgcttactcttagcagttagtgctatagtattctattacattagtgccagttatttcagacttctctggctttttaattttgtttatatttcatttgtgctataaatggaatgtttgtattcctccaacgtttttgttgttgttgtgtgtttgtttgttttttgttaaaacctaatccctaatttgatggcattaggaggtgagggtctttgagaggcaattaggtcatggaataagtacccttatacaggaaatgtgagagctctctctctccttccaccatgtgaggacacaacaaaaagttggttgcctgtggatcatgacgcaggcccttaccagaccctgaatcttcgagtgtctcaatattggacttcctacagaccagaaccgtgagaaatacatttctgttgtttataagccactcagtctatgccattttgttattacaaccctaacagccaaggacatttataaataagttttaggcttcttggttgttaaagatctgtaaacatagagtgttttatgttttctctctatacaaatttaaatagaattttaatgagtacaattttatattttatattctagagaacgttttcctttgaaaagaggtctgtgcttcattgaagtttgagaaatattgaataaaatcttgatttattaatcagttctgtttttcattcccagcatttcattatccctggatgtttccctgctttcaacagtcgccaaggaagagagaacataggagaaagagagaacgaaagaattgatccttggctttgagtttcaaatggcacaggctctgacgcgacaaaagattaagcagaaaatattatcagggaaatgtttatctgcactttacccttatcctcagacatggtcaagattccacaggactaaattcaaaagtaggaagtaagggagcaatagaaatcccaaacagatttagagagtcaggtataggaagaatgtggcaaccatctccaagtaaaacccaggaagtaggcaatcctttgaagtccttctcatctagaacaggtaggaacagaaaaagtctcctgcctgaggttgcaggcagactggcctgcctcagtctctcagtttcccaaactcagcgtggcactagaaaaattcagtgatgccccaaagaggctctaaggataggtttattacagcccatcatgggatcaggagtagcagaatgcttcctgtggacgctgccttggagtaggggtcaggggtggctcagagtgctgccgaccagaagagttattgcaggcaggaatgaacaggacagggtggagacagtgcggagaaatgatggagacccagacatgacccacgtcatgcccacccatgtccatatagtcctgccaggtcctggcactacataagctgcatggagaagggaaaagaggaacatgctaatccagtggaatcaggcttctgatacctagtgcaatgatagagcaaaacagaaatgaggtttacttgcataaaaataacatcaaaacaaacaacaacaaatctatcctttctctgtatctatctatctatctatctatctatctatctatctatctatctatcatctatatcatctatctatctacctgaagttgtagtgggtgagaatcattaggactctaagatcatagtcaagtttaagataatgtctatccttaagaatggaacttgaaaggttagcatgtactaggaaaaatgcagcaacttgaggaacccaaagatcaatatttttaaggatctatcttcaggatctatctagctctaaccatttctgaaatttctgcagcgttggacttttgggtcttgatgttgataataccaagcaatcatcatgatcgagtcctactgtagaagcaaagtggagcccacttgtccactgatccccactttgtatgcggatggagtttgggccaaaaatcggaggtccagacctctgatgtcttccgagtaaagctaagcttttgtgccattttggagatagtaacatgcaaagatgggctgccagccacaataagatgaaaataacgagaaatagattttgtgtacaatcaagaagtctccaagtagagtgtcaatgctgtgattcttgatactgactgtctactggtaaatggttcctgggtcacttatatttgaatcagggccacctggctcttgggcagatgagttgtggcactaaacttcagaaagctgatccactgctcagtcatctgggaaaactgaggcagcctaccaggcccctaaatataatctgtagtgtatttgtcttaaattgattagaaaaacagaaaatggaaggttgtttccatactcatctggcttctaggattgatataactatttttcccttttttttttctccaatagccagggaggaaaaatccagtctcatcccactgatattaagatagccaaccttctagtgttttagagatcagattgtattcgctttctagtttttctaagattgtaaacccttagtagaaagtcttctacacctgatgtttttctatacacaatgtcaatacttagtacataaatataagatttttgatacatttgacaattcctattctgctgagtccaaatttccgggaatgtctgataatgtacagagaagctacaattacagcagggagatgaggcttgatgactacccaagggtacgagaagctttgcagaaggcaatggaacaatctagtttggggcaggactgccaagaaacaagttctttcaaaagtaacaaagaaaatctcatcaaattggatttcacacagacataaggctgtaattcagctgaggcaaacagcagggaaaatcattttcttgtccacttcaagtaacaaaatgattcccctcctgtcacttctgagttgattttgttcttttgccttcgaaagctgaatgaaatataaaggagaggttgtgcatctatctataagtttaaaaaaaaaaaaaaaaaaaaaaaaaggaaagctatactcagtgggaaaaatggaaagaaacagttgagttagtatctctgggacttaatctagaataaggattccaaaaatcacaatttggtctgctgttgggggagagattgttccccatgtcttccttaagcaccaaaaacaattacacagctccagcccatgtgcaagcattagcaactattctgggattgaatccaaatttgagcatgtgtaatagatgaggattttccacaatgtggaatatttgaacagataacatcagaactaacagttaatttattttttaagtaaagaagaaacaaaccataaaaacacaaggcgtttcttgctaaggttcagagacatattcagtgaaatacgcaaataccttaacaagaaataggtgacatttgacttaactctaatacaccataattagtttctttctccatcaaaaatcaaagttagtgtattttgatctaaagctagaattgagatttctctgctttttcttttggctggtcatatgaatcatgcttaaaatgggaaagccagagggtttgatgtggtccagacctatccgtagcctgtttcctatccctgattcagtcttatcagagctgtcccataatctgtacaactacccatacagcttcagaatatgataaagaaaatagacagaggttcttacatacagaaataaggcctcctcttttgtctctccctgcagagattctacaaatctttgagccaaggagattatcaaaatgactcacttttaaacaaacaaacaaacatagctcaccagtgttttttagaatgcaagaaaaaacacaaattggaaccaagaaaaatctgttaattgcttagattctttatttcccttttatgtttactgccactaattagtctggattatccaggggcctaaataaaatagtacgatctaaaaatgcatgtgttgcttttagtaagaatatcttcacttttttcttaaaagtgaagtaagactatcttcacttttcttaaacccattctattaaaaaagaataaaaaaataaaaaataaaacaaaaaactttactacattctcatctgggtcatgatcagtgctgaaatactaaccacaatagattctaactttgaaattttgacaatagttatcatactccgagtgtttactatgtacccaaataccaatactaaatattcactactcagtactttattataaccacatcacaatactttgaaacacagaatcattaaataccatcattttccgatgaaaaaactcaggtgtaggaaggttaaggaatttgctcaaagttatacagctagtaagttgcagagacatgacttgaacccaaatctcttcgactctaaattcagagctgttgaacttggcagcagtataaagtcactcctccactcaagaaacaccaatgattttatatcttatgccacaataaaaagtaaaaagactcaaaaataaaacaaaacttaagatttatagttatctggccatttcttgttagtttaatcttaattttcaccagtcatccacatgggtccccatgctaccaccccatgttccttaaagttcttacaagggcccagttcacttttgtcccttccctcacattgttttcctcacagtagtcttctgaaacgcatttcctgtctctccttcccataatcccactgttaccccatgtgcatattaaactcccaggccatgtctctataaccatacacagtttaatacagttgcaatccaagttagtgttcatcatttagctgctatagatagtagttggtgtcatgtagcttacatttgtatttcacctaaagtaaaccattatctattaaggtcagggactacaaatttataatttgattttttacctcaaaacacactatgaaactcatagagagctctaaataaattcctgttgtttaaatgaataaataagagttcattacaaatataacaaagtattttcacatgaatttcctagacacttcatattggtgtgagccacttcaaaacagtacaaaagggattaaatacaaatatatctttttaatacttattaaaatgttagacaattcagctttagtaggagtttaattataaaatgaaaccaagcaaagcctaaatacctaattcaaaagatttctgttctatagtgaaagacagatcaataatgataaattggatttttagcctttgggaataaatggggaaccaaaaagaaaagcaaaccttagtaaagtaattctggtctaccactagtgagtggacaaaattattttacaatcagtattacattctattggaatgaaaacaagatatattaaaaccttaacatgataaatagatatttgatattatttgtccaataataatccttaacagatataagcttttttagaacatctatgtaaccaaatgtttttgaaagaggaccaatccatttgctaaagccataaagtcatttagaactactgataataaacagtgacaaacagtgaaggcgatggtttcggaatacttcactttccttttcattcctttttccctcgcctttacaccagcaaagaaaaagtcatcataaagccaatgaagctaaagctctagggctacctgcttacacaggcttcgtcaaagtctatctatttataaatagcaagtaagatttttaaaattccttttcttgaagagtgccctccaaactgtttaagcttcaggtcccacaaaccttaattagtcgcatccttgacctgaagcatgcatgcccttggaatccaagaaacttaaaattccatttggcaaaatttgctgttgttgttgtggctttcttaggctgttggtttcctaattcgttcattcattcattcttcattcatccactcatttatccaaggaacagagactcatcttttgcaggcagagatcatcgttcttacggctttagagtgactacaacttcctgtctcttgttctatggcttctgccactaacaggtaaaggcatcacgctttcctctggatagcttttctgtactttatgccttccgtttttttctcatcttttgttgttctctctattgacctgtgcatttttgctacaagtagttacttcatcctatatctggtttatggttcccaagattggttttgttatatctgtagttattccttgttgggcaaaactttcagagtagactaccagcagattatttgcaggccataataggctgctcactataacatgccctgccctggtcaaacaaatggaagaaaccaacaatcgatgccttccatgaatccacttttactttctttctttttcttcctcacagcattattatttcaccttcataaccagaaaaatataattctatccagcattataattagtcaaatatttcatgttttatttattttttctctatccccacagggcttagtgttaattgaaataatatcattataattaattaaaatacaaatacagctaccatcatcttactatgtgtttggaacacaactattgttttcatgtgtcacttcccctaattctctccaaaccccttgaggtagttgttactccattaaccatttcacaaacggggaaagtgagactcagagagcttaggcaggttgctcagttaataagcatggttgctaggatttaatctaggaggtctaattctagagcagcaactttcacttgtgaacactggaatcacctgaggagtcttaaaaatccaggtcccatccccagagtttctgatggatagaagatgtagcctggccggggttgccgggggggggggggggggggcgctgtttttcatcttcctcggtgattctcctatgtcccaggtctacagaccaagttatttaccattaggtaataaagagtgaatggacaattgaatgcattaatgcatgacctccccattctctattttttaatagataggttctgagagttccatttaaataaaaacatcaataacatctaattggcctctcagaaaataatgaaacccattttgtcaaaattgatttaccctgaccaaacctgttgccaaagagttaatgctctttcccggagagaggcagtgaacagattccgtaaatgaccagcttagtctaactccctttttcacgtggacaggggccgtgttggggaagctgcagagcgcatcaaactgaagctgtttgaatgggcccctaggtccatttctttgttttatgtcctccaattccctcagcctattatccttaatgtgtcatccctacttgttttgcctctactggggagtgggagcctcagcgctacaggcaattagcactcagagtaggcaatgggagcttcattttctaccctgcagccaaattttttgttagtcacagtcaaaccaaagatacagaataaagaacctagacaaaactataaatacttaccaagcaccaatttgttatgtgttagtcactgaactgacattataaagtgactaagaaattcaaggagttaataacctggggtgggtgagaggaggataggcatgtggaacaagatgagttgtgaatatttaacttgtgtgtgtgtgtttgtgtgtctatgcgtgattcagtctgatcatgctgaggtttgtgaaccaccaccttatcaactagttctacctactccttatagaactgaggggctaactaaacaggcatccagtcagagcatctgtgacaattagagtccaatccacaaaccctgcagcaaacggtccaggaagccaaactgcaaactctgcagcaatcagcctagagcaggtaggtcttggccaataacaaccagcgtccctgacttttgccttgcttccaactcaggatcaaccaaagaaaattaattatgctccccaaagcagtcatagaagatgctccacttctaggtaacctgccctcagcttccctgtgccaacaacctccaatcagggcactcctgaagccttcccattttgcattataaaactttcccattcccgtgtctgcctttgagtctttgccaaaatgcaagttgcaagagacagtggctgactcccttgctgtagcaagttctgaataaataacctctgtttcttctcatttaaattgcctttgtttatttttacagtgcaagtgggtggtggggggtggtggtgcggatgctgttttgaaattttaagctcaccctctccaagcaggtgaaccttctcatatgtgtttccctgaaatctccttgcctcccccttaagatgtgtgtaggaagggggaaggcagaatgacagaaagagggaatggcacctgcatcaaatccagacagatcaacccaaggagacagaggcttgacttcttgccagtgttacagtggcatttgaataagaacctaagaccttagcctcaacctctaaagaggaatgaaatcgtgaattcagtcaccattatgtttgaaatgacagaaaaatcacgccatccattgagtttccttagatatgatgaggtttttgaaacatcatatgcaatgaacattcaagcaggaatcaagttcagttagggagaaatacaattatattttgtcatggttgaatactcagtggtgctaatttgggttgcctactttggaagtttagagaggacgatatgcactgagaaagggcggagctcagggcccaaatggtggaagaggtagcattttgagctgaccaggaaagatgagaattttgagaagtggaactttagcttcctccaggctccagagacattggtgcaaatgtcttattgaaattaagcacataagtttaatgtaatacagaagtcagtgcagtggctatacccctgtccctttgctggttgtcagctcagtgggtgggtggatgctgtattcactcaaatctagaaagttgtgagtacactgatgtctgtgggttgggtcacaccaacccacagacatcagtgtactcacaactttctacatttgttgctgaggttctttttaatttctacaattattcaacatgtgtctgaatgctaaaaataactagcgtaaccaaacatagagagaaacattttcttgttaaggctgagtttttaaacaaacaaaaataatgcctttccccactgcctaatgtacatttttaaatcatagaaattgggttctttgttaaattcactgtccctctttctctccaacattgatattagtaagacagttttttttttctcccttctagaagaatgtggcagaatgagcacaaagtaattagcaggtttagttagaagttagaaactgagaggcaaatgaaattaaagttggggtaaattaattagtaaaaggtgctagagttgtgtgtgctccttaactaagtgttgtctttcaatgtgtcagcactgacaacactttgtgaggtttagaaacacagaagaggaaaggctgacaaccagggagccagaacgggaaggtgttgagcagggtgtgagactcctgggaagggaagaataggaaccatccctgggattgttctagccttcccaatcctttcctctgaggttcagcagtgcaagggagaccatcaggtcaacgtgggggagggtacttggcccatgtttctagacatcgggaaatctgtgctgaggagccttggaggccagtgtccattcataagagcctaaagtccttacgaagaaacaaaaacaaaaacaaacaaaagctgggcctgtatattagttttctagggctgccatagcaaatatcacagactagggggcttaaacaacagagaaatctgttttctcagttctggaagctgtaagtccaagattaaggtgccagtagagtgttttcttctgaggtctgtcttctccccgtgtcttcacatggtcttccctccctgtttttctgtgtctgtattagtctgttctcacactgctataaagaaatactccagactgggtaatttataaaggaaagaggtttatttgactcacagttctgcatggctggggaagcttcaggcaacttataatcatggtggaaggtgaaggagaaacaaatgcacatcttacgtggtgacaggtgagagtgagtgtttgtcagctcaggaaaatctaccatttataaaaccatcagctctcatgagagttcactcactatcacaaaaacagaatgagggaaaccgccctcacaatccaatcgcttcccaccagttctctccctaaatacctggggattaaaattcaagatgagatttgggtggggacacaaagcctaaccatatcagtcctaatctcttcttcctgtgaaaacaccggtcttactaaattaaggcccacctcaatgacttcaattaatcttacatacaagtttgaagagtccatctccaaatacagtcacattttgaggcactaggggttagaatttcaacatgtaaattctggggaggcacaattcagcccataacagcttgctgaagaattctgtagaaaaggaagctgagtgtgtgacagtttgccccactgtgtgctttaaaatgaactagcttctcgaagaatacataagccatcttattctggaatggcataagtgctttcttgtccccaattctccagcaaaaccggctgggcaaggcaggagacattacaactaccaaagctattccaatccatacacaaccccaggtgactcctacatgaaatcagccggccctttgccccactgctgtccggcccccttatgcagaaaaaggagtgcaaaggcaaagggagaaggcatataggagcttttacacttagaaattgcagagtagttatttttcatatgtattaaatcctggttttcttggttgatgggccattatgattagaaattttacttgatggtatgaaagcatcttgctgttttctttgtttaattatttgatggtgagtaatcacatattcaagcctaagtcactcgttacatattttaataagaatcttttgtcttagaaagtaaaagtgctgactgcatgccttctcatttggaaggcagcatcttgtaatgaagtcagcaaagacagagaacatgttttattaaaatactacttctaattccatctgtgtgaccttgagcaagttacttaacctgtcggaactacatatttctcattggtaaaatacaatcatgtaaaggagaagtaagtgagatattgcatacaaaacaacaagcatattgcccaaaacataaccttttgcttatctaggttaattatgcaggtagattcccatgtttccagtacgatgtcatgaaaataaaaggaccccatgcaaggatcccaaaagcctgattgtaagtccaatttgatattttgttcaatcacttggcctctgtcagcttcagaattttgaatgttaaattggaggcaatggccatcttttgaacttgacacaatttatcaagaggatgaagtatgtaaaagtatcaaaaatgagtcactggcaggctctgataatgagttaggagcatctccttcatcataaagagttcatttttggggacaaagtattaactctttgcaaattactggaatgattaggtaaaatttactaaaaatttctcttgtaggaatcatttctcagccaaacaatgtagcctaaagaaagtggggctaattttgcagatcaagttttttttttttttaagtgcgtacacattttgaaaatcaatattttcccccaggtactcagggttaaattgctcttgtaggaatcatttctcaaccaaaacaatgtagcctaaagaaagtggggctaatttttgcagatcaagcttttctttttaagtgcgtatacgttttgaaaatcagtattttcccccagttattcagggttaaattgttcttgtaggaatcatttctcaaccaaaacaatgtagcctaaagaaagtggggttaatttttgcagatcaagtttttttttttttttttttaagtgcgtatacattttgaaaatcaatattttcccccagttattcagggttatctgataattcttagcccagtggaaatggaaatggtacctgcactccacatttcctaagttctgaatttgtttgatatatgttgttccacagtcattgtttccaggtcctacccctgcatccaacaataaacctggtattcaaacaaagcagatgtcgagaatgaggatgaggaagtgaggtgagaagggcacacatgtgaagaggacatagggcataccctctagtactttcaactttaagttgattctaggacattaggatgacaactgagtctggtaccttgctccagttctagtttctacctgaaggactctagagatggggaagtttctgtcaaagagtttcttctctggacattttttcccctttaagctactggttaaaaattactgttgactggctgggcacggtggctcatgcctgtaatcccagcactttgggaggccaaggcgggcagatcacaaggtcaggagatcaagaccatcctggctaacatggtgaaaccccatctctaccaaaaaaaaatacaaaaaattaaccggacttggtggcgggcgcctgtagtcccagctacttgggaggctgaggcaggagaatggcgtgaacctggaaggcggagtttgcagtgagccaagatcgtgccactgcactccagcctgaacgacagagcaagttaaaaaaaaaaaattactgttgactttgacttttgggtaaaatatgtattcttttatttatctcatttatatttattgaatgcctgtaatgtgacagggactgttctaggaacctgggaaacatttctgagcaaaaaacagaaacatccctgtcctcacagagcttgtgatttcaaaattatctttttctgagttaaaagtcaaccatttgtttttaaagacatggtggagcatggcaattttcaaactttttgatttcagagcctctttacgctcttaaaaactgttaaagactgtaaagaacttttgttgataccagttatatctatcactatttactatattaaatgttaaaacagaaatttaaaacaataaacaattttaatttattaaaataatgatataaaaccattacatgccaaaaataactgctacagaataaatatttgtatgcccctaaaattcacacgttgaagccctaacccccaatgtgatgatacttggaggttattgggttgagataaggtcatgtgggtggggccctcgcaatgggattattgtccttaaaggaagaggaagagataccagagtactctctctccactttcatgtaccaaagaaaggccgtgtgaatgtatagcaagcatgtggctgtctccgagccaagaagatggccaacaccagaacataaccacgctggcaccctgtgctcagacttccagcttccagaactgtgagaaaataaatgtccgttgcttaggtcacccagtctgtagtattttgttacagtagcccaagctaagacaataacatattttgtaaaaaaacaaaaaaacaacaaaaaaaaaacaacaaaaaaaacctatattttctttaaaaatcatgagaaggacactgttttacatttttaaaaatatatatattttttgttctggtttaacagaatagttgtattttcatggctgctcctttattcaacttgtggtatcaacgtcatacagtgtttggaaagtcccactatacatttatgagagaatgagaaagaaaaaggcaaatcatgtattaatattattatgaaaatagttttgtcttcatggatcccctgatggtgtctcagagatccctgggggtccctggactacgttttgagaactgatggtatagtgggaaaagtgcctctctgctaaactgagttttgatctgtgatcttgagaaattttttcatctctctcaacctctgcttcttccatctgaaaatgagtcgtttgtcttacaaaatgggcagaatctttcccatctgtgaccttccttgctctgtctgccctctttccttcttgagttggccatttagtattttaatggaatggacttagttttctttttcttcttcttttgctctccacattatccccatattcctggatctggcactaatcagggctagcataaaagaaggggggtctttgtgatatttgaagcttaaaaaggtacagactcctagcaaaaaagtccagggctagtctatgcagcctcaccttgacagtgcagctgacatagtattgacaacagatacctgaccccagaatggacaggtaagggcagctttctttttatttatttttcctctccctcaagagcatgatctcatctacatgatctcaactccattcagctacatcctgaaaaactgtgatgactgacaaaaggaaccgaagtgggactttgatatgggcaaataagaagcaaagtagtttagaaatatccaagacaaatagaattccccggtgaagtcagccccacttggagacagtggcttcataagtcctgaatgatgcctctgcccctaccttttgctccagagaagcctccccagtctgaactctttgctattgagaagccagcgtgactagatgaataagcagtggttctcggacttgaatgtgcatcagaatcagcaggagggctttttttattttattttgtcttattttattttattttattttattttattttattttattttattgtgagacagagtcttgccctgtcacctaggctggagtgcaatggtgccatctcagctcacagcaacctccgcctcagggttcaaatgattctcctgcctcagcctcctgagtagcagggattagaggtgcccgccaccatgcccagttaatttttgtatttttagtagagacggggtttcaccatgttggccaggctggtcttgaactcctgacctcgtgatctgcccacctcggccttccaaagtgttgggattccaggtgtgagccaacgcgcctggcccatcagggctttattaacacagatttcagggcccatttccacagcttctaattcatcaggtctggggtagagttagagcaattgcatttccaacaagttctcaggtgaccgcacgttgggaaccagtgcaacacagtaaattatagatgatttgagctaaaggatggcaatgagacttttggactctgaatgtctctgtaatctgtttacaaaacaaccatactaccaggcctccaacataatagtttgttccattctaacctcttatgattaagggtgaagtaaaaagggtcacatcactcactatatttttagagtagttattctaagaggagattctataaggagcacactataacctttttataaagcttattttctattttatgttctcctgcttggggtgggagggacttctagagggatggcaggggttactatatggttaaagccttaatttgaacaatttctttttagtcgttacagtgcagatgtaaagtattagcagtgaacatggggcttgagttcatgattgagacagggtataaataccctgcaattatcttaggcagactgagcctgtaatctttccagtctgggtttagcttcatttttccatgaccttttaccaagtataaacacaacgtcaaagattctaatggttgaaataaatgcagtctattatgttatacaaattaagatcagtgtttggaagtccagggctgaaatcagaagattttgtggagaccattacggccatctggtaagttctccctggccttatagggccaagagatgagaagataataaatcagttaagcacttggcattgtgtttgtttcacatacagtatctcatccaatcctggtgatttcttttggtagtgagagcgactacaaatagaatccctattcaacatacaggaaaagagaggctctgagaaatcaaactatttgtttcaaggcagcccaactcaaacagaactcagatttgagccattgtgtatctgactctaactcccacagctctcaggaaacacaaaattcaactttttgacaatgaatatttatcaatatcaactttgttgagagaagagaaatagcaaaaaaaaaaaaaaagaaaagaaaaaaggtttttgtctcttggtatttccaatttagtgaagagaaataagagtgtttctggaagggatcaagttcaccttctcattttactcatgagaaaaccaaggtccagagaaatcaaatggtttctttgtagacaaaaagcaagtagcaagggtgtcttgatacctttaaatctacagagaaatgctgaacaattctttctaatgaaaaatttgcttatttaaagaattctttttgctttcttgccaaagcaaaccttccaggtagaaagaagactggtatctaggcttttacatgggctctctgtcaaggtcaggcatgaatagcaagtcctaaattctcacctgaccttgaaggtcctgaaatgctctttctgttcctgcaactggccaagttgttttcacctctggacctttgcatttgctattctctctacctgggatattcttcatttggattttcatgaggccaagtcttactcatcactcaggtctcaactcaagaagatcccctctaagaggtcttccctcttggctgtcctaagagcccaggatgtcagttctcttacagggcaattgcttctgcatcccattaccagagggagtgtgttctctgggattaactggctttcctcattttactgtctcacttccccttctctcaccatacttactgagatcaactccctaatacatcacttgcctttaattccttcttttggggtttgcttttgtgacaacccaaacacagaaacgaaatcttattcaacctgtctctcatgactctgattattttttatagcacttattactactgtctgaaattattgtatttattaacttgtttatcatctgcacttccatcttacctgactctccgcactctccccaacctcctccaccccatcagacgcctaatagaatacaaacactgtagtggcatgactttgcctgtcctgttcactgtggtatcccaaaaacttagaacctagcccataataggtgcttaacatatgtttattgaagaaatgaaagaaacaaatgaaactctccaatgtgttaatataaaggaatcttggctagtaaatcgtgattttgaactactaaatcaaaggctttctctgtttgcttcagtcccatttagattccattgttctttccatttttggagggaatcaatccttaatcaatcactttttgctaagcatgctgtccctgcacaatcaaaagttaacaaagatatataaaaatcagtccaggctttggagccaaaaagttcattatctgcctcaatcaatatttataacaggtatactgaagacatgctaaagcagaagtctctgttcctttgctttccttccatcacatttgccttgcataatcatctatgtttattaaaagggttcctggtctgttcctgttaaacattgaccttcaagtgcttgacttaataagctggagaattacaataaatcagacagccttgttcaatcattgatattacaaagaattgcaaggagaaaccagaacagcttgaaaacacaataaagtacaacagctttcatagagagtaaaagggaaagtcaagggaagaaagtctgttctcagagatgctctcatggaattaagagagcagaatcccatggcattcaagactgttttccccctgattaaaacgttttgtcaaagcaaaaatcaaatgagtacttgcttatgaagcatgcgatgtttcagaacatgacacaggaatcataagtgttcaaataaataaaccccattcaggaaaaagagcatttgtcacagatttttccctatatgaagccaatataggagactataaggattgagggtaaggatgctattccctgaaatggtttgcctccataagagattataaggcaccaaaagtgcagatgtctctattctatttaccaactccttctcataaacccggtgcctagaaaagggcttgccacatagtaggtgatcaatgcatacctcatttagagaaagaatacagagctatttgtactttcttgggagcaaaagattctcatttgcaacatgtttaaactagcatagcccatctttggcttacgttattatcagtaaggagcactatgattatgtgctatttcttacatatcttattgcatccccagaaacagataatattccatttagataagtcttgtgttaagaactgaattctgtgtgataagtaaaagattagtatttggagccaggcgcttaccattctaagctttcttttcctgatatttaaaatggggctattaatgctaatcactttataggcttgacggacagattaaataaggttgttgatatggtttggctgtgacactacccatatctcaccttgaattgtaataattcccaggtgtcaagggcagggtcaggtggagataactgaatcacggcggcggttcccccatactgttctcgtggtagtgaataagtctcatgagatctcatggttttataaatgggagttcccttgcacaagctctcttgcctaccatcatgtaggatgtcactttgctcctcctttgccttccaccacgattgtgaggcctacctagccacgtagaactgtgagtcaattaaacctctttcctttataaatttcccagtctccggtatgtcttcattagcagtgtgaaaacagacagcatctatgtagcactcaggacaaagtagacactcaatacacattggttaacctcacatttcacgggtgagaaaactttggttcagaaggattggatgaccttctccaggatcaccccactgggaattagtgaagacagaatttcagaaaacaaaacttcagatctctctgaccacagaacccatgctcttcatccaagcatcattgtgtccacggcaaggagtgtaattcaggtgcaaactttgcatattttcatttcagtttacctggcttacatatagtagctgttggcatcaaaagtacttgcttttaaaatgatgaactggctgctgttgactttgggaatgggagtgaatttacgaaagttctcaaccttggggaatttttctcactttataatatagatagacagaaaacttgggtcattttaaatgcaagatatttaggagtggattcgctaagtttgctatttaaaatgtgtctgataaaagttgatgttcttgggataaatgtgtcataagttgagataatgtaaccagtgttgaagcagaaatgttaaaaaaaaaaacagtgtgaatgtaaatgatgttttgtatatcactgactcaaagacttcttacataccatcctcctacctatacttcatgctgtattagctgaactataaagtggcaagtggcaatgtgattttcattttctcccggcaaaacgttttgacctaggagggagccttgaatgaccttggccttccattccctgattttttactgttccttttttttttaatccttctatatcctccctcatatccctaagccatactgaatgtcttgcagttttgttagtcttgatgctacattagaatcacctcgcaaaattgtaaaagttgcagatacctaggcatcacttgcagagagtcttaatcagttgcttgaggtatcatttctaaagatttcctaaatgattctaatgcatagctgtgtttgagaatcaccgcaatttttctgcctctgaaccattacagaagttaaaatttctttctttctctttatcctctgtgtaattcctagccattcttcaaaatgcaattcagaaggcactagttccaagaaacgtcatcattgcataatgttggtctgcctttgtatttaaaaatttctctgtgcttcatgctaatccacaatagatttcactaaactaaattccttgaacatgaagacaagccatggaaattgtttgtttgtattcatagtgcctagaattgtccatgtaggagctatttaaaaatatgttaaaaatgaatgagtggttgagaaaggaattcttaaaaagaggttaataactctgggtacttgtcctggctgtgctgtttacaaatttgccctataactctgatgctatgttgactgcaattagatttaaaatactatagtatataaagttaaacatatgcatatattatgactcagcaatttcccacttagacatccaaagaaatgtatagataatcattgagttataatggggttacagtccaatatatccatcataattcaaaaacactgtaaattaaaaattcacttaatatccctctaaaccctttttaaacttacaaaatcataagtcaagccattgtaagtccagatgctccttgacttatgctgggattataacccccaaaaggccataatctagttgaaaaatcctaaattgaaccattttaggtcagggaacgtatttctgtatatatatgctccccgaaggtatgtagtagattgttcatagtggcacatttttaataaccaaaaagcaaaagcaatcatcaatgtccatcagcagcaaaacggataaaatatttgtggcatagacacacataggataccatgtagcaacaagaatcctataaacgcatgcaatgatgtagatgaataatagataactttgaacatatggagccaatcgcaaaaaagtacactattgtatgttatacatttacatatagaactaaaaccaaaaaagcaatctcttctttagaagtcagggcagtcgggtggatcacgaggtcaggaaatcgagaccatcctggctaacacggtgaaaccccgtctctactaaaaatacaaaaaaattagctgggcatgctggcgggcacctgcagtcccagctactcaggagattgaggcaggagaacggagtgaacccgggaggcggagcttgcagtgagccgagattgcaccactgcactccagcctgggcgacagaaggagactcagtctcaaaacaaaaacaaaaacaaaaacaaaaataaaaaccggaagagggcaatgattggaaggaagcacaagggtggattctggggtgctggttgtgcttttgatctggtcattgattaccctgttgtgtccagtttattagaaatacatcaagcagtacactttggatatgtatacttttctgtatatacattgtacttccatgaaaagttaatactttggtataaacaatatgatagatttgtatttataaagtgactttgatctaaaccttagaaacacttggttaatatctgaaagaatttaccttccaggtatggcttctcaaatggggccattgtattggatggcagtgttaatcagtgttaattttttcagtcagagagaggtaccgtggtaatgaggagggcgtgtgatggagattgtgtgtgaaagatggagatttattgtgctgtcctgacagatgtttactaagttttaaaatatttcaaaataaataatttaaaatgtgaaaaaaagagaattttgttgcccttgtttcagaatcttccatgcaaaatgtttatcaagcctcgtaaaagcaccaacaacaggaatttcaccagccatataagaacagcctgtttctgtttaacttgttcttctatcacttactattaaaagttttgtccctttgacagaatcagatttgccacttgtatttgtaatacaccaccctataaatcattaaaggcctccaatgttcacccaaatcctcatacttgtggaatgaatatgccggattaggagaagccatttatcctcttggatactggatccagattattctcatctgtagagcattgggttgtatttgatgacattctcagtttttaactttgatctagattattattaaaagtgcctcatttctctctcagaggtgtcttggttttgaaaataattatatggttttcctgcttccaaggaatcttccagatttagctttctagacatctatggttttaaagatgtgaactagattcagcagaccactgaagtgcggggtaggcatctccctgtgtgtttgtccttgtgtagcagatgcagatttataacatgttagaataagaaatttttgcggccaggcacggtggctcacgcctgtaatcctagcactttgggacgctaaggcaggcagattacctgagctcaggagttcgagaccagcctgggcaacatggtgaaatgtcgtctctactaaacgacaaaaaaaaaaaaaaaaaaaaaattagccaggtgcctgtaatcccagctacttgggacgctgaggcaggagaattgcttgaacccaggaggcagaagttgcagtcagctgagatggtgccactgcaccccagcctgggcaacagagtgaggctccatctcagaaaaaaaaaaaaaatgttttgcaaatgtcaaaaattcaaaaataatcccttttagggaagggaattcattaattgcctcattgctaatgattattacacatgctaagatttcccttcttgagtgatgctgaaagtaggacagaaggatcacgtcattaagacattcctgttttcaatgtctctgggtttgtcctatttacaatcaaaagttgcctacttcctcacatacacaatgttaatgctttattttcaaaacctcctgggtttaacatgtgtaattattaatttattcaacaaatgatggagagagagagtacattatctgctatgtgccaagaacttaaaagggtcagggcagattattgaggcaaccggaaaatgaggatgattccttcagtccttctgcatcccatatttccatggagtcctgtgggtctttatggcaactcttgttttcttaaactcttattccctagtccacatcttgtgctaccttttcttgtcttctattctgcccaggctccaaggttaggcaattcaactatcatctccctgaattaatcaaccgtcttcatcttccatcatcctaatctatactgctcacttagtaaatttagtaaatgccacttagtaaatgccattcctatttgctaaatactgacagttaagacaattttaaaaatattactacaatttcttctgattctgccataatttcttgttatgtgatctcagtgaaactcatgagattttttctcatttcttttattaagttgtattttgttttctaatttttactctcaagccaccaactttcaaagaaggaaacatacacactagaaagcccagacgttttgcttcatggagtagactgaggccattagtttccttttctaactcaaagtttctctgtgtcatcattcacatctttcgacttcccttctgccctggaggaaagaatgtctttcttctttccccagttgcttggacactagtttccttctgtacaattctttcttatctaaccccccaaacccataaaatctaacttgagttctcaaaatgagactaaatttgttctgaggtctccccagaccacccacaggtgacctttgaacaacatgggtttgaatgacccaggtccaattatttgtggattttttccacctctgccacccctgagatagtaagaccaacccctcctcttcctccttcttagtctactcaatatgaagatgacgaagatgaagacttatatgatgatccacttccatttaaaaaatagtaaacatattttctccttcttttaatctttttaataacatttcctttctcttgtttacttagttgtaagaataccacatacaatacacatagcatacaaaatacatgttgatttactatgttattggtaaagcttctggccaaaagtatgtcattactagttacgttttggaggaatcaaacgttatacatgaattttcaactgcaaacgggggtcagcatccctaacctctgtaagtgtcaactgtatttccaaagccaataactcttctaagtttgcttttacatcactaaggggatttgaaaattggccatcctgttcttgaaattctttcttctcttggcttcttctcatagatttttccttctctgctcttccccaagattcctgttccatttcctctactcttgttttctgaaaatatacatcccccaagcttgtgtcctctgcccactattctatcaatataatcccattcactgttctcatgaatctttaactgtcttttaccttagaaagccatattgtgagtcaacacagagctccatgatgcatagccttcggccataaacacagctaggaaatgagggcagaaactaccatgatggagtggtacttcttgacctaggcacctggcccatgctgatggcaccaggagacaaggctgcaaggaaaggtcaactttacaaatggcatcagtagaactagaacatgacaatctagctacaaaattctcacatacggattcaggtaaactccgagatcttttacaatgaaccattcaaagactgggatcacttaagacagtctgcagaggtctcacaaaatggacattttagaaaagatggtcaggttcaccagactgcctcttataaagtatatcattgctgctctctgctggtcaaaagcattattctcttcaattaagatgagcagaggtgtagaatgggtcaaagagggaaagcagtgctttcaaaatgatatggactggtgctaggtaagacttattaaatgacttcatagactgcaatatacattcttatgcagaaacactgattttagtgagggtctattggacccctaaagtaaagatgtgcaaagcatccccatttttgtagaccttttactcatagaaaatatgggctctatcagatatttcttcaaccactaaactagtcaccactttttagtgtagaacttactgtaaggcatcatgtttgtatttttggcaggaaaattggcaagtcctactgaggattattaacttgatatactgcaaaatcctaaaatgttatcttaatcctaaaataaagattaaatctacatatacgtacaatctattctactgaaaacttatttttaagagtgtatgggtagtagtttttgattattcagaatatttgcatacaaagtgtccttcatgagcagcacaaaggggcaaatcttgggctcgaaagcctaacacacaggtttacccaggctctgccacttactggctttatttccttgggtcagctcttgaatatccttgagctccacgtccctattttgaaatgcgggaaatcataatacccacctcctattgttattacaaatattaattgaaatattccctatgaaatgcttaacagtgctccctgcaagttaattggcagtcagtcataactgttactattcatgtaaacagcttaagtagtagtatttattacatcttccaaaacaaaaatattttaccacgggttttaaatatactatgtagatatctggagaaagttgtctttagagctgttcttagctctgacactggctgtgtaatttaaagtaatgtcttaaattttctgagccttgaaatgtttccggatgcttgccgtgccctaaggtcctaacatgtctctatgttttaattttatttaccactgttcagtggcctatggtacaaagggttttgttttctgacctactgttccccacctaatgacttgcctgaagaacaaattaccactggaggaagcgagtaatctttctggagaattagcaaaggataatttttagaaggaacaatggaagcagaaaagtacacacgcacaatcttgcctttctcttttcggatattaccacactaaaatatgatctgactcttctgtgtttattagttcagcaaataggcattgggttttcactgggtttgtaaactagaagttacagtgtgctgaatcttgagaaaactgattgctagaggtagaacaacaagaatgttccagatgtttcctgtcctttcctccattcctccattaggtacctctcaaagcctaagttgatgataattctcttgggatgcaggtttagacatgtctatattaagagacatggcagggagtcctcctccagtccaagcaaactcatcaagttccatactactgctggagggttccagcaatataaattctacagacaaagcagtgtcagtcagaccccagagttttgatacgacttagatataagggttgagtcaggacaaactattaatttctgtcttctgtagtcactgtcccttttccttgagaatcttcctcatttatttgtgacttcctcctttctccaacaagacctctcgtacctttttatgatgctatacaagctcagctgcctccatgctctgcccaggcctgccttccttaactgcacactgtgggcccttctcataaccaaactctgggttccattcctttgatcaaccctactgaattcatgaacacatcaggctaatatttcccttttctgtcctgtcgtcttggcaaaatatttgaacaagagggattagggttgaacatggtaaaagatcaattctcatggttagatttcaaggccagaaagaccctgaaaacctttcagaattgtggtacccgacgacaccaccagtgcactggaagagctccctctatcacacagagcaaatgacagaagaagcaaccctttcaatcaaaagacagcagcagtgaatagcatttccacagatgaagaagatgtggaacagaacttaaatcccttccaatggtttcctcgatgctcaagcttttcttatcagggaaggcagggtaaattcttgttctcccccatactccatatttttcttttttcatttctttgtaatacaatatttgatacatttgaagatgccatatctttagttaaaaaaagaggctttgtttgattctaatatttatcaaattagtaaactcttttagcatcttatcatctagtcaaaatgcctttagagtgatgtcttagatctgagtctgtgttaaagtaatgttttaactttttggagcctctgttcatctgctcaacaggtataacaattcctgtttcaggacttactacaataaaaacatggtaaaatacagttatgatgagattactagcattttaatgaaaaaagcagtggtaaacttagaaataggaaatttttccatagtaataaaaactctagatgttattatgaacacgtttagaaataatagttaataaaacatgtatttttctaaaatgaaggctttttcccttacacaggcttttttgtttttttttttttgatggagtcttgctctattacccaggctagactgcaatggtatgacctcagctcactgcaacctctgcctcctaggttcaagtgattctccttcctcagcctcccgagtagctgggactacaggcacatgccatcacactcggctaatttttgtatttttagtagagacagggtttcaccatgttggccaggttagtctcgaactcgtgacctcaagtgatctgcccgactcggcctcccaaagtgcatatgctgagtcattgccatctacatgtcttcgctttgctggtgttgtttctgccacctggaattcttttttctatttccaattccttctcaactctgtgccctaaggatcccactcaaatagtgtaaatattattaattcctcaaaactcagttctgtcagattccccatcttatttttcttattgtacttataccttgcttgtcaaactttatattcttatatattttcaaacacaaatatgctttttcatgctgtggtctttctgtctacagagcatgccatcattcttgttccttctacaaatcacttactaatcctaaaagccaaattctgaagactttctcaataagttcttgcacaaaggtaaggcacttctttctttttcttcttcttttttttggttgttctctcaccattgttttacatccctgtggttggcagaattatggcctcatgatgtccaagaactagtccccaagaactatgaagatgttaacttacatactaaaagggactttgcgtatgtgattaccttaaggatcttgaaatggggagattatactagataatcctggtaggcagaatgtattcctaaaggttgtaaactgaaagagagaggtgggaggctgagtgtcagggcaatgcagtatgagaagactcggccgccatggctggctttgaagatggaaaggagtcatgaggcaggagtgcgggcagcctggagaggatgggaaaggcaagacggattctcccctagagtctccagaaagaaacacgggcctgccaagaacttcattttaccctagtgaaagtcattcagacttctgacctccaaaacgataaggtaataaatgtgtgttgtttccaaccattaagtctatggtaattgattccagtagccataggaagccaatacaatcactccactctaacactaggtatttttttaacttgggtttgcatgttgctttatgttagatttctttaaaaagaatcccacatcacactaagactcttatttatttatgagttttctctggagcaaaaatcaggaaagtgagacctgcagcctgagctgccataggtgcattactcgtttcaattatttgctttgtcctcggaagacaagaaaacgaaaaagagagacagataagacaaaaatagaaacgtaaacaaaagtaagcacctctttcagttttattatatcagtcagaagtacttcaggtaaaatgggaagaatgccaacatgtttttgagcatgtactaggtaaaatggtcattagagaaactgtgaatttggatacatggcccagatgccccttcaatgatggactttgcccagtttgctcagagtactgtcagcagaacaccccctgtggccagctcctcagggatggcttcagctgtagacgattatcttgctgtgatcacacccttcccagcccacatccaaagagacatgactttccatctcgactcaactcaggacaaccctaaaggaacgttctagccttagcactgcccctggaattggctgaggctttctttgaaagtgaaacacagctcaacttcttctgctcgggcttactgtctttctctccgtccgtccatagatgtgaatctcaggggcatcccataataaatatcctacacactaaatacctcctgaggggctgtttccgagggactctaacctatgacactatttttagaagtgtagaagaaaacacaagtgtagaaaggttaatttactctccctcagccacgtttaatgatcagtctttttaaccccagagtccacattctttctaacatactgagcttctcacactgggctatgtatcaagtcaaagttacaggatagatgtccctggagagtcaattttacccaattaccagaaatttaacacactctctcagattcaaaagttcatagtagagtgcgaaattcaatgagcttttaagaaaaagcatgatctttcaaaaaaatagtcttttatttattacaggcagctacagtatagattgccgtcaggctgcttggctttgaatccatgttttgctggttactacctgtgtggccttatgcaatttgctttctcttttgggcctcagcctctccacctaaaaatcaggttataaaagtacacattccatgagaatattgagaagaacaaaattatatcattcatgtaaacttcttagaacaacatttggtacatcttaagtgctcagtaagtgcttacaatcttatcaaagcccatcaaagcccattccctttcctctgtgtttagagtacttaattaactaattaactaatgcatctaaaaggattgcacaatgttaacataacgcacctcctctgtgcctcgattttaatttaaaactttatgctaataattttctgtctcctccaacgcaccccgctattctaaaaaccagcttgaatttaataataataatacataaaccctcaatattctcttatctcctaatgaatcaagtccaaacactgcaggctgctttccaatgccctttatgatctgaccctcatccagttttccagtcttttttctgaatttgccctgacaaagtggactactctagtccctgccccctcctttctttctgcaaaagtgcatttgctcaggttggttgccaaggttggaaagtccctgtccatctgctattgatcacctttaaggtcctctcagtctcagtttcttcatgaagccctccctgtcccctgcagcctgcctctgtctccacctccgctagcatgcattatctgggacagtcacttattgcagttgatccttttggtcaagtataacttgtacacacaggcataacttggagatgctgtgagtttgtttctagaccctggcaataaagcaaatatagcaacagaacaagtcagacaaactttttgatttccactgcataaaatgttatgttcatagtatactgtagtttattgtgtgtaatagcattatctctaaggaagagatgcacataccttagttcaaaaacactttaatactaaaaaatggtgacacagagacatgaagtgagtacatactgttggaaaaatggcactgatagactcgttcaatgcagggttgccacaaatcttcaattggtaaaatacataatatctgcaaagcacaataaaatgaggtatgtctggacaaacagactgtgagtgccctaagaacagggagtctctgttttctgtcttttcataacaagtactaagataaaaaaaaacttatagacattcaataattatttcttttgaatgttagtatttacataatcatcattttttgatattgtttgttctagttgagaaaaagtgtcagatataatttgaaaaaaatatgaagaaggaaaatttggtctcttctctgtagacaatgaaatccctgattttatgtagaaacatgtagagtctactgtgttggcttaatgtttgaatacacgcttaccatagaagaactcagataggaaaagtttaggaaaagtatgacccatcttttattgaaatgtacactttaattctgtgaaaatatttcaatgtaaaagaaatgatgcaagtaaatctgcatccattcaacaataaaatctctttttagggcattacaaaaggtaatgaggtcaagcaaggtaacatgtgagtttgtatatagtttcaggataaggagacaacagaaaataacaacaaaaaaaaaaaaccctggctcaagtctgtaatcccagcactttgggaggccgaggtgtgtggatcacgaggtcagaagttcgagaccagcctggccaacatagtgaaaccctgtctctactaaaaatactaaaaatttgcgaggtgtggtggtgtgcgcctgtaatcccagctactcgggaggctgaggcaggagaatcgtgtgaacccgggaggctgaggttgcagtgagctgagatcgtgccactgcactccagcctgggcgacagtgcgagacaccgtctcaaaaaaaaaaaaaaaaaaacccaaaaaacaaacaaaaacaaaagttaaacaaaatctaggctgccctgggctgaggatcttagaaactactttgatcagaagaaggacaaaaggagcttctgtattatttgttcggtgaatagtttgatctgaaatgaaaaagagcttaggccacgtaagattccagtgagaggtgatgaattggctagctttgggaataatcagtactgtgcattacaaataggaggggttagttacatctacacatcccagaacttttatactcctggaagatggcaggacaggcttatggctattctttgactttagctattctgttttgggggctctgtagtgaagattatctctaatcatcaacttgctgcttcagaaatgtgattttcaatcagggttcctagggtgctgagagctcctggatgtgtgagctgtacttaacggcaaagatctgaggtcagagttgctatcttcctatgtgtctcccgcccttgccttcctgccagcatctcttcaccttgtcgtgctttcagagcaggaactgacgcaaattgggtgttggactcccaagaaacgtgtcacagctatttagaaagtgataataatcctaatgccctgtaatgatttgaggattaaggaataaaactgcaaatatgatgcatggcatataaatgttgaaagtaggtgcttaaatggagacaaaatctgtgaaggagaccaactcatttggcattttcatattcttactatgtttagttcatatctatataacatagagaagtgtggatcctgcaaactaagacatggaggggaatttctttatacctgcaagaaaaaaaaattataaaagacattgaaactgaccaaaaagattactaggtgttgtgcagaatcctcaagatagctcccccaacattcaggtttcctagttatttgatcaagcattaattcaggtactccctaggaagacattttgcagacgtgaagtcctaagtcagttgaccctaaaatacagagattatctacataaacttaatctaataaaaccagcccttaaaagtggagaacagagaacttcgtccactggtggcagggggagaaacagaaagatccaaagcaagagaaggactcaaagctccattgctggtttgcagatagagaagattaagtgagaagtaataagggtggtctctaggagtggagagtgaccattgaccaatagtcagcaaggaaatggggaacctcagtcctacaaccacatggaactgaattctgccagtaacctgaatgagcttggaaggagattcttccccagagattccaggcagtagcccagcccagcaacaccttgattttggccttatgaaacccagtggtaaaggcagctgagataagctagacacttgatctacacttgatcataaatgggtattgttttaagccactaactttatggttatttgttacactgtaatagaaaactaatacacttggtgttttcaatggaccactaggctttgtttaaccacagccatcacagtttcttttttttttttgagatggagtctcactctgtcacccaggctggagtacagtggcatgatcttggctcactgcaacctccacctcccaggttcaagcaattctctacctcagcctcctgagtagctgggattacaggcacccaccaccatgcccagctagttttttttttttgtatttttagtagagatggggtttcaccatcttggccaggctggtcttgaactcctggcctggtgatccacccaccttggtctcccaaagtgctgcgattacaggcgtgagccaccgcgccaggcccagagttcttattctgtgaagtctctgtgcctttaactccccttgagtgagtgtacagctctgtaagttgtagataactgataacaatacaaatatttttgtctatagatacacacatgaattttatccttcagaaatacaacccccttctgccccatgcaataaaccagtattatatttgtcagttcacgttggcattactaatctgccaatatgtgagtggtactttaaatccttctttgaaccagttgtaacatccataccatgctaaagagttaaataaaatccttgatgtacttattttatatctgtataagagtcattattttacccttttataaaacatatcatttaatagagatacattcagagatttctaaaatttacagggcaaggactgtttattcatcccagagtttatgtcaaaaaaagagctaaatattgtacataagctcatctattcctcatgctaaacccctgaccctggtatgaagagtccctaattgaaataaagaaaccaaaactcaggcacatcacaaaacatactgtagagcacacagtgctggagtcttggagctgagaatttggcatactggaatataaagctactactacttccgttgttccatagagctttccaatgtaaaatggggctcatctcctttcaccctaacccagcatctcctccttatttcttcagtccattcttgatgtgaatattttcctcctcagtcaagtttgaaaacttagagccatttttgtcctttcatttccttttctttctatatccattggttatcaaatgccttaagttcagcatctaccatctcttgtagcctcttcctctttctgtttctgctactatcatctgagtttcttctcacactaatagcagctcaaataggcaaacaggaccagatctgagttttgggagtttggcacttttacaattttagagggccatctttagggaaaaaaaaaaatagtaatatgaatacaaaatgaaacatttattcagaatgagaaaataagccacaagaaatcaacaatcttagaacttcttatttctttgttttgagatctctgatggcaatttaccagaaatttttacatacaggtgattcctgactgtaactcaaaacccttccccgctctaaactccctgcaactccacctactcacaggggccatgcaaagaagtaaccctaatactcaggcttccgtagctttagaaacttagagtctctactatcaattctttttccatttttagtaaaggaaataaattaagcaatggaaggtctaacaaattattcagagtttcatggaggtggggagaggttacgaacctgggacgttttaaacactcagattcctgaattataacccaatattctaaataaaaacctgaggacatctgtatttttacaaggctccacaggtgaaatggatgcaactgacctatgaattacaaatttgaaaaccactgctctagctcaactgcatgaaaagtgacctgatcctctgtctccaaaggttaaagctttcagagtgcaacagagtcctccaatatttcctgggcactgtggtctgtacaatgcaaaattcagaagctataaaaaatggaggtgaaaagggccctgattaaagactgaaacagaagcaactgcttttctctctgtgcagctaccatactggtcttgattcaagtaaagcaatgtgcctgatgagaatcactgaagcacagaaaatggtctggtactgagagatgagcaaatgaatcccaagtatcaggagtacacaggaccagaaaagaagtatttccaatacccacgcctgactaaagatttcactagcctcttagctcaaagggacaatagataaacatcaggtctacactgcaaatttgcctgcatattaattataatttatttcttctatctttgtccttgcattagactgtttaattccgtgtatgaattcattttgaagtgtagagtccatcgttctcagtaattagctttacaaagtctatcatcgaaaatattgttttagattctttgaatacagattctatgaaagagaaaaatccttaaaagtgggagactcggccgggcgcagtggctcacgcctgtaaccccatcactttgggaggctgaggcgggaggatcacgaggtcacgagatcgagaccatcttggctaacacagtgaaaccccgtctctactaaaaatacaaaaaattagccaggcgtggtggcgggcgcctatagtcccagctactcaggaggctgaggcaggagaatggggtgaacccgggaggcggagcttgcagtgagcagagatcacgccattgcactccagcctgggcgacagagcgagactcgtctcaaaaaaaagaaaaaaaaaagtggaagaccaataagaattattcagattctactggccagagcaggaagctcagctaccagcatttatctttagactcctaccacatatgattgccccaactgaaacacaggtcagagagtctgctgtacttctaaagtgatgagaacaaatcttcctgtcactttatgtcacagtcatacagttcccgaatagcaacccatagatagagcccttggcaaatttgttatcagcggtgtgtgtttacacacatcaagtgtctgggaaataaagaaaaaaaggaaaatattgacagtgtagaggatgttctttcttctggaaactcataagattttgaaacacagctgaatattttgaacatacctttatgttcaaaataaattaggaaatgattcaatactaagcataattgaagtcatagaaaagcattttttattcttttgctctattaagacacatttcattgtttctcatggttactgagtggtacatcgctgtatatacatatttatataagtatattagatgtaccttttgtgtgtgtatgtatatgtatatatatgtggggggcatatatttatatatatttatagcaacatatactgtatacttctacacactttgctctccgtcctgggaggtggaccagaagggttaaaaagtgcctgtgtcctctggcttccggttgggctcagcctagggagtgcctggcctgagctggagggaggtgaggtattcaagatccctccctgaggcttggctgcaactgggtagggtacactccttgaccaaaggctacagttccattccttggacctatctacccgatgcccccacccccaaacctgggttccaataacttccctcttcactccttcagttctcggggaggcccagtttgcactgctgttgccagccagagagaccgtagctttccttatggtttccctacaacctttgtaaatagttcctttattaaactcttttcaaattacccaatttgtgtgatccgtatcttcctgacttggaccctgatatttttactgaatattgactagtaagtgtattgctcatgaactgaactgcttcagagttgttgagctcctaacacataatttattatttttctttattatcaaagtttttaaaaatgtatttactcctaatttctttcaaaaatagatttatgacaggaattattttgatgttatattccaggccattaaaagcatcaagtactttggccaggcgcggtggctcacacctgttatcccatcactttgggaggccaaggtgggtggatctctttaggttaggagttcgagaccagcctgaccaacatggtgaaaccctgtctctactaaaaatacaaaaattagccgagcatggtggcagatgcctgtaatcccagctacttgggaggctgatgtgggagaattgcttgaacctgggaagcagatgttgcagtgagccaagatcacgccactacactccagcctggacaacaaaagtgaaactccgtctcaaaaaaaaaaaaaaaaaaaaagaaaaaaagttcaagtactttgggaataatagtaagaggaattaaaaaaatcaagtactatttttatgaattctgggcattttcccctccaaatcatagaccaaagactactcaatgaatactcagtgaatctcttcatgttatgaaaatcaggaaactgctgcctaatggcttaacctttgatgtaatgattttcgctcagtagcttaaatctatgacaatgttcatatttattgaattctactctttgcctttaggctaaggaactatatgctttatgacattgtatattataaagaacaatctataccaaaataacaaccttcagagaacaaaaaacagaggatgctggagtcagcaattgctaagatactggacagacagcaaggtgagtaatggagttaataatctggaatatggaatactgacactactaaaaccatatttgggtgactaaattaacgccacacttctcatccacctacataatgtttacgcatccaatgatgatagttacgtttatccaatgtcaaggcatgcttacaccgttctgacatataatacctttaccaaatgctaattattttattaatttaaaaaatatttaaatataagaagtgaaattccactgtcaagatgcattattcattgtttttcctgtatcagttcaaaaaatattattcttaaaaaagaactggaccaaattccaactgtgatactacagaagaaaaaaaaaaaagctgaagtaaacaacattaagaaaggccaagtaaagtgacaaatcacagcaaataacaatttatccctactgaaaaggacagcacaattcaatttgccaaatcattttatttatctctgagtggcaatatgaatgatcaatctgttttgatgaacactaaaactttgctgaatgaaaaactgtgctgcctttaacatgtcaaatttaggtacagtaaaagaaaatgtgaattaaattggctttgagtatacagcattaaaagataaattgctagcttagaaatatctttcccagtagctttatttgaaccaaaatattttgcttaggaggaattacataagtgtgcaatctatataataattatttcttggtccctaaatttgaaatgttctcaaaagcctaaatgcagaaaaaggctaagaagattatatgaagagaaagatctggtttgatcaaagactttggctgtgaattagagagggttttatagttttgggataaacaatttagcaaaaccctgatattctttcttccttcatgcatttatgcatttaactgtttgttaaaatactcctatgtgcaaagtttgtcctaggaagtgggaattaaatattgaaaactctctgttttcaatagctccaaaaaccacataactggagctttaggacccatcttgtggctcctggaaaatgaattttaaattgaatcctgagagattagtaggagttatctaggtgaacagagaagggtctcaagtgaaaaagcttccagggagacagcaatgtctgcagaagtctagaatgagaagacgcaggaccattctaggagttccgagaagttgatttggtgaaagcaaatatgttaagttttgaaaaaggacatggttgacataaggcgagaccagaaaaaaaatttagaatgttgaggtgaaaaaattatactgtattagtaattagtcccagaatccctgttaggaaggaagctttggttacgaacatatcctaacttttagtccagaggcaagactaaggagagtataatgaagtaaagaaaagaggacgatgagttgctctgcattggaaatgaacagggatctatggtttggggacactggaaaaatgagaaaaggggaaataaaaaagcaggaataaaattataaagggaggacaaaggaattataaaaacatggattttaagttatttgtttcactgtgttggaaatgtccttttataacaccctaataatattcagtactagctaccacaaagacaaaagagagaaatgcatttgtagtgttttgtttttatttgtggaaatacaagttctatatctgttgtcatatcagggcaatgatagaattgcctgtcacggtcagtacgtagagtcaaatgttattcagcaaagagaggatgactctagcacttgcagaccccttggagatggtatgagacttttcacagggcagtgtgcagggattggagccaatcttctagttcaaaggagcatggagttccagcaaacacatagggtatgtagaactccagaaagtttgagactgatttaaggataatgggagtgttaatgagggtaatgcttggctccatttgtcatctggatacactgtaccaatggctgagagggaggcaggactgaggcagagaggccagttaggaaagcaagtatgttgggtcacttgcaaagccaccattgattctgatgttctgggatggctcccctgactgtgatctcagttcacctggttccaacctggggacacagaccaagtacttagaccttagtcaaagacattacccctgtcttagaggagggagtgatagagttgggtgattatgtgtgtgtttgcatgtatgcattggaggagtttataagcataaagggagcaagaaatatcaacatggctcaagtggttattcctctaagaccatttgtgagtataaaattgtgtgtgtggttacccacacaataagaaattgatgagaacttaattgaatcaaattagaaatttactagccccacattctgtaattctgccctggcagaaaaatggacctaaattcagactatcggtcttaatatgcatctaatgaagaagtttgaaataaaggcaatctgctgacttgggtgctttgaaaaaagaaaggactcaagttggccattatttcttgttaatcaacacagtagttaatgaatataaaatttacatccttgttacagtaacatttaagttacatctttcaacccattttgtatcttgttatcactcagttttgtttctgtctaaaaatctacttgctagaagggaaaaagagcctttctataatattagaagatttatttaaatagttctaaggactatggactgtaaacttaaaattaataatgtttgccaaaggaaatacctgtgttagaagacttgtgaaagaaacctttgttctttcacacaagagttaagtgtagcttgtcataggaggtggattttagccataaatcctagtgacactgatatcatcaatcgagtcctaagtaactctacctgtataagaaaatcatgattttattaaaattacaatggtaactaatgacttccacagtttcccacaatcacatcaggcctttacctcccttagtctacttgggctgccattaactaaataccatagaatggatgtcttcaacaaaagacaattttttttttttttttttttttttttttgctgttctggagcctgagaagcccaacatctgagtgctagcatgggtgagatctggtgtggcctctcctgctttgcagatggctgtcttctctctgtgtcctcacacggtgatgagatagagagcaagctctttggtttatagggggaccaatcttgtacaagggacccacctccatgagcccatctaaaacaaattatctcccaaaggcctcatctatcatcacattgaggattagggcttcagcatattaattttgaggggcacgattcagtccacagccctccctctgtgcttgtatcactgctttttcttccttgctgtgaatgaactgaatggtatgggcttttatctaaggacaccctctagccttgtgcataggctctgaaaagttctccttgcacagggacaacattgtcgggacttagccctttttctcctccatgctcaaatttcacttttctgttagatcagttccaacagcctgcacaatactgtaaatacttctatattgaagattaatataaaaacaaaataggctgggtgcggtggctcatgcctataatcctagcagttttggaggcagagatgggcagatcacttgaggtcagcagttcgagaccagcctgaccaacatggtgaaaacttgtctctactaaaaatacaaaaattagccaggcatggtggcacatgcctgtaatcccagctacttgggaggctgaggcaggagaattgcttgaacctgggaggcagaggttgcagtgagcccagatagcaccactgcactccagcctggatgacaaagctagactccgtttcaaaataaataaataaaataaaatttaggaaactgttgaccctacatccccttctaacttactgtctaatttcttcacttttcattagagccactcatctaatgtgtctatattcactatctctaacttcttttcttccattctctcattttttaaaaataaataagatcattatacaaaactcaaacaacataggaaagcaaaggaagtcttgcttctatcactgccccaccaaactcataatacaagccattttttttttttggtttctaatttctaattctttccacttttctaatgcagacatcaatatactgtataggcttgtctgcagtttgtttgtttttactcagatatacccaggagattttcccactgtcattatttaaagaatgagtccccaatccccaggccacagactgacaggtcctggtccgtggcctgttaggaactgggctgcacaggtggaaatgagcaaaagccagcggtgattattatcacctgagctccgcctcttgtcagatgagccgcggcattagattctcatacaagagcgaagcctattgtgaactacgcatgcgtgggatctatgttgggtattccctgatgatctgaggtcgaacagtttcctctcgaaacaatccccaccccccaaccctgtctgtggaaaaattgtcttttccacaaaactggtccctggtgccaaaagggttggggaccactaatttaaagaagttcttcattctttaattttacaatggctgtgaatggtcatcattgattcaactattccttacttgctggacattgggttgttgccattacaaacaatatcctaattaactccttaaacacatggcatttgatatttgcacaggtgtatgcacaggctagactcctagtagtagaattgttggctcaaagggtaaatacatctataatttatttcatacaatactgccaaatttccttccgtaggagttgcaccattttcaaatgtcacaaagcaacatataaaagtatttattttcctgaaaccttgccagctgagtgtattttcatattttgtatagatagatgacaaaaattgtattttcagtgttattttaatttgcatttctattatgaatgacattgagcactttttctatgtggttaaagggcattagtatttctttgttaattctctctctgtccctctctctctctctctctttatatatatacatatatatgtgtatatttatatatatatgtgtgtgtgtatatatatatatatatatatatatatgctttacttgcttttctatgaattgttggttcttctcaatttcttatagctctctatatactaaacaaattatcccattgtctggacaacaacatgcaaatcataaatccatctatattttgcttatcttgaatctggcttcctagaacctttggaattctgggaaaaccccagattcaaaaagagcttagaaacacatattttaccacctcttgggagctaaaagtacagctccttgagcactcagtcatgtaaacatgactacaaaaagccaaaggtacaaaatcacacatcatgagttctttcatcaggtatatccactcagtacccaccatgggtggtcaggtagtgctctaagtatcagagacttacagccaaacacccacaccgtaactcaaggatttacactggtcaccaaattgaagggccagttagtagttaaaaaaaaaatggaaaaaaaaggtaagaaatacattgactggcttgcagtacaaaaaaaagaaattatcctattgctgtgatgatgaattgcatcatctccattattcttcgaatttattgcaatcaagttgtttgcccttatatatactaaaattttctttgtcaagatcaaacatgacttctatgtagccaattctaatatcaattctcagttcaccactaagtgataaatggtttacatgatggataccccagttacccagattggatcatcacacattgtatgcttgtatcaagatatcacataaatgacacaaatatgtataactattatgtattcataaaaataaaatattaaaaactaaatcccccacagaaacttaaggtaaaacgattcccagagtatatgctgaatggtcattatttattgtatcttcaacccatttctgaatcatgcccagctcttatgttatagcacattttcattgcacaacccctgtgtcatcctctattgctaggattctcatttcattcatgttggaacagtgacctaaagagcttaaatgtgccattatcagatctgcaatggagatgaacacttgcctatgcaacatccatctttgtttataataaaccaccatttatattaaaagtgataatcttcccaattaaatattccatatttcccaatatgatacagctgaatctagtcctctgggaaaatttaatctatggtatgttagaagtgatgtgtgggactttaccaaagctctttaaatggaactccttcagctgagagtcatgccctccttgacttttcctctttttgtctttctgctacctggaatgtaagcataatggctggagctccaacagctgtgtttgaccatgagctgaacttgtgagtaaaagctatgttctaggacaggggtttccaaactttctgtaaccgacaaaataaatattttaggctttatagcccacacttgctctctttcatatttttctatttttgcttgatcttctttttatatactcctttaaaaagaaaaataaaatttttaattttgcagtccctacaaatgcagtctgggccagatatgcctgtgagtcctaatttactgagtcaccttactgtaggatggtgggagagaaagattagagagtgcctcatgacagcagagctggcatgccagccctattttgcgtacctccagacttcctttatgagagagaaattaatatccatcggtttaagctactgttactttgtgttttctattatgtgcagataaatgaatcctaactgataaatggccttcgaaggaaatgtacatattgcctctgccaaggaaccttagaagacattattttaaggagaaatactataaatacaaaagcatgtaaataggagaaaatttcaagggcatatttacaagagaaggttgaagtgaagaatcttctctggagggtatggaaagacgttttgataaatattattccattgatatgtcaggtgaagctagttgattgcagtcctgggagtgaggaggagcagtttgaacttgattcattagttaataaagagctattggacgttcttaatcctagtgagggcataagaaagccatcattcggaaggagtcacttgtcagtaatatagtctggactggaacacggaagctctatgctggtgatcctggagggctgaatctcaaaagtttgaaatgacaatagaaagaaaaagttgattctgagagatgttaccaggtaggggcagaatgagtggactagcatttgttagataaatgcatgtaaacgttggcagaggagggaagagttggctatatctgcaggtaataaatttctgctcttataatgtttataactatttttgctcccttgcttatctatctattattttctatattgtacacttatttcaacagaacaattcatgcttcaaccctcgaaaaattgtcattggacacaactttataccacttagctgagtttcctaatctctttcaataaataggtaagcacagaaccccagttgtagctaaagattcttgaatttattcaggtcaatatattgattaagtaataataataataactcacaatttttaagagcatggtatttgacagatgttacagactacatagattctgtgttgtcttcataagaatcctattagatggcagctgtacacagtcagcttcaccttcaatattgtgaaacggttgcttggaagaagctgtctagccaggaactgcatttccctgtatccacaccattttggtgaatgctcatgactggattttaccaatgaatgtgaacaggaatgttgttaatagcttcagggctaaaatggttatgaaagtgcaagagatgctctaaactgtctttctctgctcaaagagattctaggggatcatgaaacaattatttggagacacccaggatcccagagtcaatgcacggaaagagctatgcatgagagccacctaacacatgtaaaactgtgacatacatgagaaatatacattaattcccttaagccactgagatttttgagccaaggctggcctactgtaactaacacagtaggtgttattaacattaccatttatacaaacagaaataagacttgggaagatctgcctaagacactaagtaatagagctgtgattagcatttgaaatattcaatttcagagcccatgttcttaaccattgcccaatatcatcatctttttatataaatttgtaaaagtggtgatactgttttttttaataaactaggaagaaattctaaactcctatattttgaggtgtgttgttcatgttcacaaagccccatagccaactaataaggtaatatgcattactaatgggtaatatgcattctacattaaaaatggcatttgctttaaggaattcaatgatctaggatttaaatattttgttccaagtttaactgataattccccccaagcttttctcattggcacaataatatggcttaggggaaagtatgaaggctgagtaatcagaactgcttggatcagaacatgacctcttcggccttgagtaagacatgtaacctcgctgaggcttcgttttactctctgcaaaagacagttaacatcaccagctttttaggataattctaaatattagaaataatgctggaaatcttaataaatcactcagtacacatagacagtaatttaattcaatcaagaactatgtatttaaatgtctactataatgcatgccagacattgttgaggctccaaagatacaataaacaaaacagacaaaaatcctcacctatttgcattcaatgtattcttttttttttttctttctaacagttcataataaaagaaaccaatattaaggcactttcaattctgatcaagatggagtaacagggacaagatttacattcccatccgaaacaacaacaaccaaacaggcaaaatatattagacaatagtttaggaaacactggccattaggtaaaatagatagtgatctcggagatacctggaatgaatgagatgagccctacaattgcccaagcaattatgagacaaggaagaatgcaaaatgagattggaaaatattttaaataaaaaataaaaacacatgatatcaaaatagcaggattctactaatgcaatatgtacacagaaattgaatcactaaatatctatgttcgatagcaaaaaagatatcaaatcaatagccttaacttctaccttaacaataacatttaattagaaaaagaagagtaaattaaatcccctgtaagcaaaaggtaatgatattaatcagagcagaaaacagtaaaatagaaacagaaaacaatagaaaaaataaatgaaaccaaaatgtagttcttttaaaaaagtcaatacaatcaataaacctctagccaggctaatcagaaaaaaagagagaaaatacaaattatcagcatcaagaaagaagggacataactacaaatttttctgatagtagagaataatatagaaacattgtgaaaaaaaaacacgcatgtgaaatgaacaattttcatgaaagataaaaacaaccaaattttactcaggaagaaataggtactctaaataaccctgtatctgttaaacacattaaagttacagttaaaaaatttctcacaaggaatgttctaggcccagatggttttgccttcgattctaccaaacatacaacggggagattatacaaattcaaagcaaattcttcctgaagacaaaagaaggaagacttccacaaatattctatgagccagcattaccccagtatcaaagccagggaaaggcgttacaaataaaaaaaaatacagagtaatatctctgatgaccattggtgcaaaatttctaaagaaaatgccagcaaatcaaatctaacagtgtataaaatgataatgcattatgatcaagtggggcttatctcaggaatgcagttagtttaactttagaaaatcagtgtctgtaatttacaatattaacaaactaaaaaagtgattatttcaatagatactgaaaaagaatttgacaaaactgcaatgtgaattcctgacaaacactctcagcaaatcaagaacaaaaggaaacttcctcagtgtgataaaaagcatcttttaaaaacttacagctaatttaatggttatatttaaaaaacttaatattttccctctaatatcatgattatgagaagttatctactcttacctgttcgaattgtatagtgcagattctagccagtgcaacaacaaaaaaaagaaatacagtattgagcatgaagaagatatatttatttaaagatgacagaactgtctatgtataaattccaatgaaatctacataaatatctaatagaaataattgcatgcagtgagactgcagcatacaatatcaatataaaaataacttccattaaattgaaattaaatattatttataatagcttcataaattgataacttagtaaagttatcaattttccccaaattgatttacagagtcaataaaatccaaaccaaactcacagcgggcattgtttatttggtagaaatcaacaagctgatttgaaattaatgtggaaatccaatgaatctagactagccagggaaattttaaaagaaaagaaagaacaaagttggaggaataacagtgccagaattcaagactgattataaagctacaattattaatatagtgtgtgtcattggtgtaataaaagacaagttaatcaatggaatagaaatggacccatgaatatgtagaatattgatttttaataatgctataggctaagcaatggaggaaaatatcgtatttttagaaaattatactaaagatatgtttgagggggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagccggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaaccatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaactaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagttttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagccctcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaatcatatgtttgaaagcatcaaaaaaaaaaaaaaaaaaaaaaaaaagaaaattatactaaaaattaggtattcaaatgaaaattatttaattcatacctcacaccatgtacaaaaattaactcaaaatgcatcatagatctaaatataaaatgatacaacttctagaaaacaaggaaaaaaatcttagtactcttggattaggcaaaggttttctagatatgagaccaaaaacataatccataaaaaaattaagtgggactccattaaatttgaaaattctggtcttttaaagacactgacaggaaaatatagttatatagctaatatgggggagggagtggtatggattgaatgtttgtgtcctctctaaaattcatgttaaaactaaatttccaatgcagcagcattaagaggtgcggcctttaagagatgacttggccatgctggctctgccttcatcaataaattcctgccttagaaaagtcttgagagcgtgagtttacctctactgtcccttccaccttgggaggacacagtatttattcctctggagcatgcaggaacagggcaccatcttggaagcagaaaacagcccttaccagacactgaacctgcagacaccttgatcttagacttttcaacctccagaactgtgagcaatatatttatgctatttataaattacccagtctaaggttttttgttatagcatcacaaatgaactaagacaggaagaggagaaaacttgtacttagaatatgtgaagtgctctcaaaactgaataataagaaaataaacaacctatttaaagaatggacaagagtttgagcagacacttccaccaacaaagatgtacaaagggcaaataagcacaaagaaagatactccatatattagtcatgaagaaaatgcaaattcaaccataatgagatactgttacactcctggtaaactgactaagttaatattctgatcataccaagtatggtgaggaggtggagtgacaggaatgctcacaagtgctagtggtaaagtagtttatctgtcttctaaaaagttaaacatgcacctacaatatgacccatttatcttactcctagggatttactcaagagaacagaaagcatatagacatacaaaggcttgtccacaaatattcataacagcattattcataatagccccaaagtggaacaacccaaatgcccaacaagaagtgagtggatggcctggtgcggtggctcacgcctgtaaacccagcactttgggaggccaaggcgggcggatcacttgaggtcaggagttcaaaaccagccttgccaacatggcaaaaccccgtctctgctaaaaatacaaaaattagccgggtgtagtggcaggtgcctctaatcccagctacttgggaggctgaggcaagagaatcgcttgaacctgggaggtggaggttgcagtgagctgagatcacgccattgcactccagcctgggggacagagctacactccatctcaaaaaaaaaaaaaaaaaaaaaaaaaagaagtgagtggatggatggatggataagcaaactgttgtacatttctataatggtatactatttagcattaaagtggaatgaaatattgatgtgcacagcaaaacatctcaaaataattatatataagaagccagataaaagggtacacattgtgtgatcctatttatgtaaaattgtcaaaacagaaaaaaacccacaacacctcatgtagaaaacagacccatgttttcctggggaaggtggtgaggagggctgggagaaacaagagaaagttccagggatgatagatatatatgttcactactttgattagaattattttacgagtctatacatataccaaaacttagatactttaaatatgtacaatttgttgtatgtcaagtatagcttactttaaaaatgtaaaactataagacaaaaagaattatcatttagaattttttactgaatcaaaatattttgcagatgcatcgaattctctgcttcctatcatttagtcaaccatttgcagaggcctagagatagttttggcatggaatagatagtgtcttttcatttagcatggctaacatttaacttaaaaattgtaaagatactaacagattagaagttaaatgcttattcgctgataacatcttcaacattgagattcaaagcattgtgccccttaaagattagttcaccactggccatcagtagccacttttatttaattatatttataaaatttaaatgaatcaatgctcttgcctaagaaaattatacccaggagtacagaatgaaaaatgaaagtcctcctgctcatttttcatttctaagtacttcttcacgattaacaatgagagcaaggttgacaaagatgatgaactgccatttctaatccttcctggcaattgcattcacttattttcttttgtgaacaggaaagtacttggagagaaattatacagtgattcatggttctggggaaggctgctgatattttgatcaggccacctcagtgccctcaggaaatcaaagtgtcctatcactctgtatccattatcattacaaagatggtctgcttttaaaccatcttgatttccaggtagtaaatgattttttaaataaaaggtgtttctaaaagtattcatttgtactttttcttcatcaaaagagtattatttttattttaggaaagaacaactggagagaaagagagaaaggcttcttgcatccccattttatttgcttttaatcgttgcctttaccccaggcttcttggtaatgtgatggtgttaactaggagtccttatctctggggcaatgaccacaaaaggaaagtttagtagtagtgtcagggaaccacaagtttcagactttagtagctgtccatgaagattgtttagctctatccaacactttctgcaacttgatggccatagtttcctgagtctgagtctttagtgcaccaaaaagaagtatccatacctggaaaagtttctgttaggcacaggtatgcagattctttctttaaccataggctagataggctatggaaatggatatgcaaataaaggacagctttaccgaaactatctaaatttttctcttatatccaaagatctgttatcctagggtagctggagtcctaatttccaaaattttcagaaaagaactcaacaaccaaagaaagattagggagataactagtatctactgagtccccactatatgctcacacagaaacttatatttgtaaatcttatatctcaaggccacattagtctggaaaaaaataaagtggggtcaagacaagaactagcaacagcatatctgcctctgccttcactgtctcttgtaggatctctacactatcttctttaaacatgatttgctagcagttctgggagtcctctggtgtagctcaaagatgctcacagagagcatcctctcagtatctcgaagcatctgccaattccttcctcctggcttatcagtctttgatctatgacggctatcagacctgctgaaagtcatgaaacagctaaactacttccactctgccaatagccctagggatgttgcattcacaggtacatttatttaaaaattctccctgtgaagagttgatgtacgtgcatgttaagtcaacctatagctacagctttgaacagttatggctctctaatcaggaattaaaactctattttgttgttgttgttgttgctgagacagggtgaagtgcaggctggagtgcagtggcatgatcatggctcactgcagccttgacctcctgggctcaagtgatcctcctgcctcagcctcctaagtagcgaggactgtaggttggcaccaccatgcccagctaattttttattttgtgctgagacggggcccttctatgatgcccaggctggtttggagctcctgggctcaagcaaccctccctcctcagcctcccaaagtgctgagattacaggtgtgtaatctcaccacacccaggctgaattaaaactctagagatggttacttaagcacttaatagtgttatcagaagttgtgccagagggtttactggcaaaaatagatattagaaataagttttaattgagtaaatgaggttctaatgctaccaaattcagtcacagtcttggaaattctctatttggttttgtttgggtttcatatgtatgtagtcatactttatatttgtgtgtgtgtgtgtgtgtgtgtgtgtgtgtgtgtgtgtgtgtgttttatagtgcagccctctccttaggcttctgatatgagaacctgggcctgaacagaaggacatcagaatggttcgtcccaattagtactcaaacactcccagcctttggtcctgattttctgtattcacaatcttttgtgcaatctctactttgtattaccttaacagagttatttcccataataatttcttttctcttaagctttagacctctgttaggcccattctataatgcccacacatgtttataccaaagaagaacactcctatttctgtggaaagacaaattaaacttctgtctatcagagccttagtaaatagaagttcaaaaagcagagtttttataggaaaagaaggaatcttgagattaaagtgcattcaaggaaacaccaaattatatttagtagagctttaccagagatttatttttggaaattgttctgatagtcaaactagatagtagattccccattcacggagttctatgtggaaatactcaaaattataggttaagcatggtagatctttcattagcatcaattttaccaagctatttttgccaggataaagggaagtatttttatataagtaaaaatagtgtactactgaataataaacataatttgcttcggtttctaacagaagtctttgaagaaatgttgttttcttggttagccatttagtgtaaggccccagacttttctggaaaatttaggtaagcactaaaaagcaatatttgggattgtcagcaaacattaaatcactgtatctaaatatgaatcttctatattttaattttaaccatgatccctgcaatttgaagtgaggtaagaggaagagaaggaaagatcatccattttaaagaacaaagaggccaaaacaagcaatatcataataaatgtagcatagaattatagagaaacctgaattgaattacattgtgattgctcagtattatatcacagtcatatgtattttaagatgaattgctggggttttaattaacatgtaggaaataaaacagtggaaaataattttaaacatatttataacatatatgataatacacctgcttttaataagtcagctgaattacatttttgtatgtaaaagttaattttcctatttcatagatatggaagtttgatttgttttctaatttttctttaactccttgcattagatgaatcctatatctccaagtactatatttagtcaagtagatttcctttttaagtgaaaaatgggttttgagatagaaaagagctttgccttaatatgccaattatacagctctttttaactctaacttgtagtctgagagatggtaagatttttcagttcagttgctctcaacaactgagatattgactgactcaagtttgagttacaaataaatctacataaaaactttcactttattgattcttttcaaaaacttctaattatgctttcaggtggttaaatggcaaaatctaactgcatctatgacaaagtgagctatattaaaactgtgggataaaggagaaaatgactactaaccagtgggcaactgtcaacaatacttccctaaaacaactgttgacaagctgctagacaaatgtcaacttagatgagttcaataaaagtagatcctgcagaatgagagggagtccctgtgttggcagagaggagcctgtctttgttagagacagaatactaaaactgtgctgatcttgggtggctgtacccaagaattcatcctttcactggacagtttccaagttattgtactttataaaataattggcattatcatgtttccatatactaagtcaatataagtgcattttcagaacagcgatgggatcagatttcactcagaatccctctgtcagaagaatccagaactcacaaaatcctattgttccaattaagaacatggatttgggaacacctggatttgaatcctgcccttctttttagcttggtgaccttggccaagtcaccaagtgatcctttatttgtagaataggaatagtcatagttagctccatgttgcccgggaagaataaatgtagtgacatgtgtgtgagatcttagtagagcacatggactcagcacttgctcagttcatggtagctctcaacagcctccaagacacaaggagtcagctgacatttctataaatacttgtctcagctcttgggcaagtgggaacttgtgttctacaaactctgatcattgaatcgataggatttcacttagcatagttctttaactttcctaggagccaacatctactgagcacttaccatgtaacaggctctattctgatgttgttttgttttgttttgttttgagacagagtctcactctgttgccaaggctgcagtgcagtggcgtgatcttggctcactgcaacctctgcctcccgggttcaagcaattctcctgcctcagcctcccgagtagctgggattataggtatgcgccaccatgcctggatggctaatttttgtatttttagtagagaaggggtttcaccacattggccagtctggtctcaaacacctgacctcaagcaatccgccggccttgacctcccaaagtgctgggattacaggcatgagccactgtgcccagcctattctgaatgttttaactgaattaatccatttaatactgatatgaactgtgtgagatagaaagtaaccttattttacagagaaaaataaaattatgttataggattgccttgtattgaaaaactagtggggggaagagatgggattgaaatgaaaataatctaacacataaacttgtgtctttattgctacttttattgcctctcctactgagatgtaatgtccctaaggaaaggatgattttgaatgttttgatgtcctccaagcacttgacatgttgtcctggcacagcatgcatgttgttctttagggatctcccaatttatttgaggagattcaatgtgcaaggatggtaaaacataatggcatttataaagccccactctggtccaagtattggattcggtggcttattggcctcattttatcctcaaactgactttgaaccataggtgtgcttacccttatctataagtcaatcaggcttcccaggtatcatacagaccccactccggtgtgtttaaacagaaatggaattcattaaaggtagttctgagaatttctaagtgagctggagcatcatactcagatgattcttggtcaagttcagtgcccaacctcatccccaggactgcatacggaagcggcactacagctcgtatggctaacgctgaacattgaaatcactgacactgtttttcttggcatctgctggctttaccacaacccttgccaggaaatagattctgtttcctcacttccaaattgaagtcttccaagagcgcatctgattgatggaggcttaggtcaaacatctgccttaactgcaagggaagctgaaaaaagtgtgtgaatttaaattcagagaagcaagacttgtaaactgagggaatttcctgattacaggaaagatattaaaaagtgctaggtttgggggaaaaaaaaccactttgtaaatatccactacacttccattttacagatgagaagactaaagctcataggttagatcactgagtgcatatcacgtgagtagtaagcagaagactgagcatatagaggcagacctgtctccccacacaaagaaataacaaagcgatgagaggtttcaacagtcaatagcagagcagttcaggggaggaaggctcccttccgggtgcggtgatcacaaaaggcccaagcaaagtaacatcatttggacagctccctagaatcctcatctcaaggctgtaagaaaaatcttaggaatgatttagtgcacattcttcattccacggaggaggaaactgaggcttgtagaaaagaattgctctgcccaaggtcatagcctctttgtggcaagtagctgaaaacccaaacccgtgacagtaggtccagtgctctctgcagcaagccgtggaccccacctgctaaatcacatctctggcagaactgtcgggcagactttctttgaattgacaaacagaatgggagagaaagtcacgtgcttcagtcaaagcaaaaaagaaaagcttttattctgtatgtggtttctcatagaatacttctcgcccagctgcgcccaagtaggtaaaaggctcttgcttatgctaaggagcctttcttatctctgcacaccccactcctttcctgctaataccaagtacagaaggcaatgaaagaaaaggtcacctgccttcctcctaatgggacactgatgtttttaagtgctcacgtgatctgtcccagaaaatgtcaaattgttcccttataactctaagttggcggttagttgagtggctctgttgtccagacaatggatccactcaatttttgcctctcatttgaacacccacatttaaaaaaacttgggaagaaaataatggaaaagttgacctctcagttttccggaaaaggtgaccatacaaatgtgtcttttctggctgtaggctttatgaaacttctgagaagaagcgtggtattttagataaaaacaagggtttggttgttagactgtcctgtggttgaaattcagctctatccttgctggtgtgtgatcttggacaaaagacttaaacttcctgagactcagtttgtatgcaaaatgagaataattataaatttgtaggggattagaaataatgcagattcttgacatttattatggacttgttatacatgaaggattattagtttcactctttatttcattaactactttgacttaagctggtctctttgatgaactttcattgactctctggtacttgacatttgtataatattactttcaaaaatgcattagtaggctgggcgcagtggctcatgcctataatctcagcactttgggaggccgaggtgggcagatcacctggggtcaggaactcagatcaagaccagcctggccaacatggtgaaacctcatttctactaaaaatacaaaaattagccaggcctggtggtgcatgcctgtaatcccagctacttgggaggctgaggcagaagaatcacttgaacccgtggaggttgcggtggaccgagattgcaccattgcactccagcccctgggtgacagagcgagacactgtctcaaaaaaaaaaaaaagaaaaaaaaagcattagtaatatgttaactcatattattttcagcaagctttttaaaatatgattttgttacttttttttacagataaggacactgcattgatgagtccttaagtaactggtgaccaagatggccttaatgtctccctcagcttgactaaggtttacataggtttctttttgactctaggccactggcttcttttttcttagataatttacttaaaaaaaaaaactctgcaattgtaaattatttctctacaatctagagatgtctttctcaaggatttgggactaatttccttgaagtcatagaagaaaataagatgcctatcttcctatctttgggagggtagaggatccttagacaagtgacagccaatacaaatggcctaatcacattgaccaactacagtagtcctcccttatccttatccgtgagggatatggataattcatttcagtaaatgcctgaaaccacagatagttctgacccctatgtctattacacacaaatttctttttccttcacaatttcgtggatagaagattcattcttaccctagattttagcaacttcagcatacgatttttttccttaactagacaactttcaccttttcacccaaaggaaatactttatggcttctcattggaatattcaaattgccagtatcactactcttgtgctttggggccatgattaaataaaataagagttacttgaacgcaagcactgcaatacttcacagttcatctgataactgagaagactactaagtgacaaagggaggattcatgtcccaagcaggaaagagtgggccagggtaagattttgacatgctacgcagaatgccatgcagtttatgacttataaattgtttatgtctgggattttcctttaatattttagatggcagctgaccacagataaatgaaactacagaaagggaaaccccaaataagggaggactatggtatacctctaccgtcttccagtacttttccattagctcatcccagagtttaaaactcccatttgtttttttttagagttgtgttcaccctttctctttcccattgcaataatcttgacctctactgaaatagtccagaataaaacctttcttgcctgtctaacttgtctgaggcaatttcttttacactggcccaaagtcactgaattagacaaggtaaagctaagatttttagtcaagtcatttgtgtttttctcatatggacttaagttgggctttaagaccaagactgcagaccaaatttttattctaagaaaggcattatcctggaatcacaatctaactaaaacagcctttgttttctcctctgaaaagtgagaaagctggactagattcctgtctcacagttggatcttggagatccttcacaagccttgatggactagggaagaggggaccaaaagaggcctgactgggggctccacaatcatgcatgcttaataaataaataaaataaattggggccatatgttgacctcatcaagaagggtggatgctgctacaagtaaaaaaatggaaaatcactggattctaacatttatatggcctgttctagctctatttattttttatttttatttttgtgatggagttttcactcttattgcccaggctagatagagtgcaatggcacagtcttgactcactgcaacctccacctcccaggtacaacaaactctcctgccttagtcacccaagtagctgggattcaggcatgtgccaccacgcccagctaatttttcctatttagtggagacagggtttcaccatgttgctcaggctcctctcgaactcctgaccttgggtgacccacccacctcggcctcccaaagtgctgggattacaggcatgggccaccatgcccggccttgttctagtaacactagctccttcctaggacatcaaaacaaatccagcacacctgtcttttcctcagagcctgctttcaaagttttatctatctcacatgtttacatgtttatctaatactgttgctgataagcagatattcagtgagtaggtactcctcagacactatctatttacattttcattaaacaggatctactttggagataatttccaagtcaaaaagaagaaaagcacttaattgataggaattccagatccctgaactaggatgacaggtgcaattggcttattcactcaagagttattgaatgcctactatatataggattcaaatccctgcattgtgtagggatttcaatatagagttaaaaaaatctggcccgtggagaatacaatctagtaaaagagatttgctatatactcaagcattctcaaaatcctaaatttaaggaagaagaattgctgatttagctttttggagttttaattcaataagaataaacacaaactatgctcaaggtatcttaccaaaccatatattacagggaataggagatgagattcacagaagcaggaaagattgtttacctttatatctcttctctccttcaactctctacttcacacctatcttcttcatagcagggctcaaaacatggctattaaatgcgtaagtaaatatttaataactacttcctgcattaaaattatattacatttggcaaggcacagcggctcacacctgtaggggtcgcagcattctgggaggccgaggcaggcaggttacctgaggtcaggaatttgagacaaacctggccaacatgacaaaacccggtctctactaaaaaacaaacaaacaaaaacaaacaaacaaaaaacaacaaaaattagccgggcatggtggtggatgcttctcaggaggctgaggcaggagaatggcttgaacctgggaggtagaggttgcagtgagctgagatcatgccattgcactccaggctgggcaacagagcaagactatgtctcaaaaaaaaaattatatatatatatatatataaaatataacatttaaaaagaaaaatttaaacaaagtttgcaataatttatcccccatgttttacaggttattatacttttccaaattaaattcaggattcaactgctaatcttggcttgagcaagacaaatctattagcatgccccaggcaggtttatcaaaaacatctttttactattaaagcctcaacctacttcagctacaaatccctgcagacttacttagcataaggcactatcatttctatcttcattacaacacagtttaattatctgccttagaaataaggttcttcctcttaatgaaagtggttagtctggtggctccaaagggcacaaggcagtttcaaggcttaattctgattatatatgcaattacaagttagaaaatatgcttgaaagtcaatgaaagttctttcatctatttctccagttagaaaacataaacattggttggaacgaagattttgttgttgatgttttacttgtctagagcattgcttttcaaatttgaagatggcgcttccaggtgtcacttagtgtcatctgatgtcagttccatcgttactggggttcacatgaaggtagtggattcacagacctcagtttatttccaggtatagtaaccatgtgtccaggatagttatttaagtcccatgggtttaactttctcatctggagtcctactttttggggttggtgatgatatttaaggaaataataggcatgtgattggtgagaatgttagctagtaattatattacttcacttaacttctcccttccaaaactgcctattctaagtgtttgcttcctcctgtcctgtcgtcagccatatttctaacatcccattctcatctgaggaccatatctcctgtgtcactgagaaaaggagtcaccagagaactccttctagttttctgtcttctaacaccaaactttttttttttttttttttgttttgagtgtctcattcattgctcaggttgcagtgcaagtggcatgatctcagctcactgcagccttgacctcctgggttcaggtgattctcccacctcatcctactgagtggctgggaccacaggttgcaccaccatgcccagctaatttttgtgtttttagcagagtttgggttttgccatgttgcccaggctggtctcaacatcctggactcaagcaatccacctgccttggcctcccaaagtgctgtgattacaggcgtgagccaccacgcccagcaaacatctatattttctattatctttccttctcccttttcatctttaaggaatttggaccccatattctaagactcatttctcagcctgggcttttgcccaactcatttgaccttcatccagaccttctccatcatttttccttgcttcttttagtgaaaccttgcactttctgctcactctggttcatttccctcagcttcaaacattgagatcatagtagccagattcagttcacaaagcatccttcacataaagttttgctaaggaaataacaaagatgtgtacaaagatttttgatcaaggatagccattgtggaaatatagtaggaagcattggaaaatgccccagtggtcaacaatataggttagctaaataaattagggcaatattggttagctaaataagatggggtgttttagaaaaatagaaaatgttatgggaaattctttagtcatgggtaaatatgtcaagctggtattaagaatcatataaatgcatgtgatgtctgcaggcaggcacatgtgggtgttatgcattgaaaaatgcatacatgctatttctggcttgtgagatacaggctaactttaattttctttgaatttccttgtattctctaaacttcatacaaaaaaacttattttctttctataataggtgagaaaacaatgttttttaaaaaatgcttctttgcccttgtgtcctttcaaatgtcaactcatttatttctttctcttagctatctttctccttaaagtacagtttacataagctacctccttccacttctttcctgattatttacttttcaatctaatgccagttcattgagcccccatcatgggtcatgcactgagcaaagcacagagcaagtcactgaggatacaaggatggtggtggctgaaaaaataatgtttttttccatcaagagctttaacaggctgctaagaaatgaagtactctctccgttgaatctatcccaagaaataagtccacaaagaccacaaatataccacaatgtttatgataacaccagtttaataagtacctaaaaatgtaattactgaaactctcataaatctcacttctgcatcattccaaaatccataaacaaacacaaaaatgctcttaaagtaattccagattaataacatgaatcaagcttctagtactagagtttatgactagaatcctaataatagtttttcattgatgttgcttaaaaataagaaaaaagattgatttatagtaataacatagatataaatatctgtatccctagagttctgctttgcaaatattaaagaatttttttatggtgagaaaccaatatacatttattagataatacttgccaataagtaaaaagtaaataaaataagaatcacacatatatatgagtataaattaatcattttggagtggaatttacagcttcagtttttacagatagtttctttctttctttcattatctgggttaaacaaaggaagaagaaactactgttggcaagttgcaatggcttctttcctctaatgtttatatgtgtgtgtgtgtgtgtatttgtgtgtatatataatatatttagtatatttgtgtatatatatagtatagtgtatttgtgtatatatatttgtgtatatatgtgtacatttagtatatatatttgtatatacatacagacatatatatataaatcttatccttatgtagtgaatacaatactatgtgaatacactatgattatgaagtgattatatagtaacattctaatctcctggttatgaaaaaaatacttaaaagtttatactgaaaggggaggatgtgttaatctgttttaagtttaggctacaggcagaatatgacttctcccaaccaaaggcaacattcttgctaactttagtatatgttaggtttcaaataccaagaacagaacttggaacaacatggacatttacagggcaatcacagtaaaacctgctgcagtagaggcacctcagatggatgcttaaccagccttataggtcaggaatatcctcctgagggaaatagcataaagacatttaagctgagtcttacaatgttagctagtctgagaggaaaccaagatagggtgacaagtttttttttcccacttaatatcatttgattaagtgtccttgatttgattaagtgtccatgcttggctccaaacatggaaactgggaagctaaaaaatagtcattctctagacattaaagctgcagcttctcttaaggctgattctcagtgatattttagctcttgatcacattaccttaccgggtttgatcatctctaagattctactataggtgggagtatcacatggattgcactgactttcaggatctttggattctcatccatacgttcatgcatccatccatccatccatccaaaccatatgtactcatatgttgaaaggggtcatggttgataccatggtataatgagctgtgaagcttctccatttagggagtttttcatgtaataggtagggctaagtcgagtgcatgtggcaggcacaagcagaatctgcagaagttctgagagtccatgtaatcgaaacagtctcctctttgacaacaaggcagtttttcttctgacttcactgcattcattacataccattactacagatactgtaattctttcctttgggcctttaacattctctgtgggaacattatttatcaaagagtaaaattttgaaacttaataaaacaaacataggagagattcatgactaacactggtacaatagtgcccttgggtcaaacatttgctttactaaaatgccaaacagtctccagtttctaccaataaaacatgacttcatttgctttcagcactgttggaatgcctctactatagcccttagtcagaggagatataattatgactatagcttcactgatattggatgttataagtggacattcagaccaattagaaagaggaatgtctgggaaagaacagtcaagggaaggaagactgttggccttgcaacaggagacctagccaagggtatttgacacattagatgcaggatgcctagtgaaataccttgagaaacaatagtgaagctatgaattggaaggaaacatttcagcagaagcaatctgaatgatgcacacgatcatatcattttcttgctcaaaacaacccagtgattcctctttggaattagaataggtctcttcagggggactgacagcatccttgcagtccagaccatacattttctttttccttactttcaacttttcctcttttccctccccctgtcctttcctttcccttcctttcctgtctttcttttcctttcctttccttctaataatacatttaaggggtacaagtacagttttgttacatggatatattgtgtagtcatgaagtatgggctttccatgtaaccatcacatgaatggtgtacattgtacccattaagtaattttctcatctcccaaccccctctacccttccagcctcacatccttccaagtctccaatgtctattattccattctccatgtccgtgtgtacacattattttcaacttcatctattccatattatcttcttaaagtgttttaaaaaattatttttaaattgttaaaatagtatatatagtatatatttatcatatgtaacatgatgttttgaaatacgtatgcatcatggaatggttcaagagagataatttacatatgcatgctctcattttttgtactgagaacattaaaaatctactcagcaattttcaaaaatatgttattaactgtagtcacattgtttgcaatagatctctaagttattcctcctatctaaatgaaaatttgtatcctttcacttacatctaacccaccaccactcccagctccagaccctgttaatcaccgttttactttctacttctataagatcaagtgttttagatttcacatatatgtgatctcttgcagcacacgtctttgtgtgcctggcttctttcactaaacataatgtcctaaaggtacctacatgttgttgtaaatgacagaatttccctctttttaaaaggccagatagtattctattgtgtatatgtaccacattttatttatccattcatctgtcaattgactccgtagtctagccattgtgaataatgctgcaatgaacatgagtgtgcaggtatctctcttcaatttattttttttcctttggatatatttattttcctttggatatatacccagaagtaagatttgctggatcacatggaatttctatttttaatttttggaggaactttatgcagttttctgtaatggctgtgttgtttttgttttttttttttttggtttttggagacagagtcttgctctgttgcccaggatgaagtgcagtggagtgatctcagctcactgcacctctgcataatggctgtaatttatatttccaccaaaagtgtactagggtcctccttttttccacatatctgccagtacttgtcatcttttgtctttttgataacagccattctaacaggtgtgaaatggtatctcattgttcccccccattcttgttccctgatttccaattgcaggtcttatccttctgctccttaagccttcccaggcattcctcttgccttggaacttgctgttccttctacctgggagtcttttctctgatctttacaatatggattctctcttatgtagatcttagctctaatgtcatctcttcagagatacttctggtcaccctgtctacagcagcccctcctttcctctcccttctcaggccatcactctctattcctttgcaataattgattttccttatatcgtatctcactaccaaaaattgttgtttattaattttcttgtatattgctgcttgttttcttatttattgacaggcagtacaaagcagtggttaaggataagaataaactccagagtcagcttgggtttgaatcccatctctatcactatgcaggtgaccatggcaagttacttaatttccctatgtttcaattttatcattaataaaattgggataaaaatagtacctgcctcataggattattgtgagaattaaatgagccaatcagcataaatcacttagaacagtacctgaaacatagtagcactaaataaattgttattattatttgtcttttacattagaataacagtaagaatcttagccctctagttcaaatgctgaattctctagcatctagcatagtgttttgcaatagcagatactcaatcaatacttgaataaatgttttataggagattgcctagaggaggagaagaaattttcaggggactagatctgaaaaagcaatttaagtcacagatgaaaagaaattcgctattacgtaatgaagacgagagatgggaggggttgttagcacaattagctgtaacctggtattaatgaggccaaggtgataggtttggcacttttgtgtgttccacttaggttcgttctctgccatgatcatttgttctgcatttgtatggctagtcagctgtcttatgcatcaatgcccacaatcaggaagagagagaacaaagaaatacatttatcaattatggctaaggaaaatccatctgaaagtgtcttcctgataaacagtggtgattcttggtgttgtcaatatggcatatttcagtactagctctctactgagttcaaaccacctagcacaggtgatctcatactaataatatttccagtgcttaaacaaccccctcctgagatggaagttgggtttgagaaattaggatgagcattcccaatttcttctcccttcctgaaatatttttggttgccaccaggtggtactaggtaagcacatccgaacaggacaatgtagttttattatacaaaagattgccaagagttgcaaaaaaattcctacgtataacttctagaaagattactattgtataagacagaatacacttcacttttggtttagacttttaaaacaatgtttcatactatctaatattcaaattgtgctaaggtttgggagaagactccatcttcctatgatgaacgctttcattttggagtagcttttgtcttaagcaggaattaaaaatcctaagtcatgacaatttcaggtctccagagaaagccttctcattttcccttagaaatttacttggaatttcgtcaggagttttcttcccctccttttcttctttatcttcctcttcctccttttctgctcattctcctcctcctactccctcttcctcttcttcctctctgtcctcttcctcttctttttcttcctcctcccttttcttcttcttcttcctcctcctccccctcctcttctcctttttctctttttccttctccttcttctaatctcctattttccttctctgcttcatagacacgtgcttttgcctgtcttagtttactcatctgagaaatggggctagaaatacatgcctaactaggttctttaaatgtgaaagcatgtatttgagtgagtagtcagtaaaagatagcttgtctttgtcatcatcattctaatggacattttcaactaatccttagggtcaaaattattccagttcattttctttatttgataggattttaactgtctttttatccatttccataattggcaaatgagttcacatgaggcatctactgtatcagcatgcagctatgagaagaagcatcagaaaaaataattgccactgcctgggcacaaatttttccctccctgtcttaacaaactgctttatttctgaccccttaactacagtgtttcttgttcaatgctgagtacatcttgcaaaccaagcttgaaacacagacctgctctctatcctagagagtaaccttctttctttaatctgaaacataaataacctacctcttatttccaggtgaatagctgtctatttctatttgactttctgatcatgtgtccacttttccaagcttatatcctcaatatcccttttacaaagatttaccctgtctttccttttcctctgagtataatactattttaagaactttctgctcagaacttttattatcctgaagactacagccaaattgtcataaggaaacagtgactttgtgaaagaagtatgtacttttcaaagctcaactccttgtccagacacatctggcaacacctacaaatactgtcagctaaggctcctgctgtggtcatagaactacagcattatctcagagagtctgtaaagtcctcttattctggggaagtgggtaagaaagtcgaagtagggatggaataagggaaagagagtgtagataaaagaaattctcctgaagagtatgtcaccttttcaagcatctctaagtgaaattggttcagattcctaatcttacatacaattcaataattaaagaagggttaagataaattcaaatcggcatcacttatgcatttaaagaacacgtacaattttcctttctgctttctcaaccctttttaagtttatttgtttatttttgagacaggatctcactctgtcacccaggctaaagtgcagtggtgcagtcccatctcacagcggccttcacctgccacgctcaagcaatcctctcacctcagtctcccaagtagctgggactacaggcatatgccaccatgtccagttaattttttaaattttcttttgtagagacagagtcttactatgttgcccaggctgatcttgaactcctgggctcaagggatccctcatcccaaagtgctgggatcacaggtgtgagacactgggcccagctcaatctttttatttaatagcccaacttcacaggatttagaaaaaatagtcaccaaatatcctattttagggtagcatgagcattttctttttcctgaactccatatgtttggcttaaggcaatgtggatattttctcattttattttattctcagcaatatagcaagaagtaattcatttattttgttaaatctctaatgtatagcttagctgaagtcaataaaagtcaaagttaccattcacataggctatggtccatttctgacaatctcaaaaccatgccatggcacttaaaaaaacctgctattttatatgtatacttaggtttctcattcaaaactaagcaaacatggaattcaaaggaagttaatcatgtgtgactgcagagtggaaataaaatgaaatttctaatggtaacaaatatataatcagatcattaatgtttattaagggcaaagggacattccaaacactgcggcaaattgtaaagtgctgtaacctctaagagtgagacctgctctgtcatcctcactgagatttctacctaattcgttaaaattcatttttgtttattttaagtatgcatacttgccctctgctaggaacagagggaaatgcgtgaaaaggttaatggggttttgattacttgaatgggcagaggagaattccttgtcaggagcacattgcctgtaggtcaaactggttacaataatgccctatggttttagggcatttagattctccttactaattcttcagaatcctcattttttttttctgcaggtatttttctctgcctgcagatcatgcactctctatgctcaatacattctgacaacacactagtcctgctctaattcacctgagacaaaatggcagcaaatacaaaataaccttccaggctggctcgaaattagcataggctctgtagcccaacggccccagggctgaaaactgtaccctttactagacagataactttgggaaagtcactcaatttttctgaacttcagttttatcatctgtcaaatgggtctaactatcaataatgacaattgctgccaattcccagttcatcaggtagatgtgacagtaatatgagaaaacttttacaaatcatgtagcacatagtcaacagatcagtatttactaatactacttaagtatgtggaggaaatgcttgtcatatttaataatttttagttatttatcttagtcatgagttttgattattgacaacattgctccaaagagttttgttttaattgccttacagatgctgtgttataaaggaggacagttttgtgctggagtgaaggataaacacaggggaaaggcacattttcaaagcagcaatctcttgactagccatatcctgctttttactcacttaaacctctaaatccacagctgcaagcaaccaaaggccacaagtcccaaagaagcaatctaatcaaagaaaacattgaatcaaactggcttctctcccttctcctcaactggcatgaaaaatgctaaaggtggtaataataataatatatttaacatttctcatgttttttgtttctaaaacatatggtttcttgctacatgtagagaattgctaagacattcatttcagctttcagctcttgcaaattaaacatacgttgtgtaaaaactactttaaatgaatgatttttgaaatgaagttttaaaaagtactctttgagagatgaactcccttttttccatatatgtatctggatttctttatgtcttttttgagtagcatcccctcacaagagtagcatcccgaaggaaacttcatagcattaaccatcatggtaatagattaattactaatacaagtatttgtttaaggtctaacttattaactagagggtgagatctctaacagcaggggtcctgcctgttcaccacttcatcatcaaaatctagaaaggagctaggcacatagtagaacctcaaaaaagtttggaaaggcagaacaggttgtggtgaggagacagctgtagagttagaaagtcctagaattgaatctgaataaaaccttacacactctttgcatacttgggcaaaattcttaagttccctaatcagtttcctctttgataaaataaggagaataatacttatgttgcagagctattgtaaaaagagtaaaataataatgtatctaaagcatacagaattatacctgatgcattccaagtgttttataaataattgctattataattatcatgattactgtatagtggatacatgtagaattaattatttaatgtgatgctgaggaccaggccttgactattgagtctttttaaaggcattgtctcccagtttcccatctgcttcacagctccatccatatgcctttttgaaatacacatccagctcctggtcctttttaaacttcgagaaaaagcatcttatgtcatcaaatgtcaatgtaatattaaaggcatttgtatctctgtttaagatcccacatctgttatcagttaatattttgagagattcttactagcagcagtttctgatccatgccataaaaaatgcttttcataaaattgtgtacaaaacccacttatgttttaaaagcccaatgatagctcactaagtatagtgatttcttcaacatgatgttgtcatctgataggtgtgtagggaagcaaagcacatttgcacttgtcctaagaaataaaaagggtccttctgaagttcatttaactcaacttttctattctcctcagttaaaaggttttgccacttgagagtgaaaaattatgaccatagaaattacattttagtaattactcagatttataaaatcatttttcaaataccaaaggtctagtaaaacattaacattcagggatttcactttcccctttatttctaaaatttgcattttatgttatgccttcagcttttctaatgaggattcaaaacatgttcatcatcaaaccattgatgcatctggatgtctacaactttgtagtttaagtccatcccttatacagtagataactattgaagaaaaccaaaactaatgtaatctttgtgaagaaacagggtttttttcagaaatatgagactagagacccaaagatttcaaaatttctgtgggagtgttgatggccgtggccatttcccactcctgaatactaattttgcatgttcccaaactgcaattctttggagtctcttgagtcatcttttagttggtaatattgttgttgcttcctttgctaagtataatctactaaacaatcttggagttctgattacagaccactgcagtatcttttaagtaactctgggaaacatgaagcctaatgttttggttcgttagtattggttagtattcattagtattggttcgttggtattggttagtattcattagtattggttcgttggtatttggttcagcagtattggttaatatgatttcaagtatggaggagagcaccgcccaacaagaatgctgtgtgtgccacacctcccttaccatttgaactaagtgcaacctttcattgtttctttttgcgagtgggtgggggggggcactgagggtgggagggcaactcctatgtaccagacatggaatcaggtgctggagattcagtgataaaccaggaaagatgaatgaaacccaaaaaccaaactagaaaggttagcaaacagttatcaaccaacattctaaaccccaatggctttaaaggtaagtctagggatgttgtactttatttgccatctcttaaaaaaggaattaaaaaatacaagaagaaagaaactctaatggccagtagccataaaatctatttacatattcttccacctctcaagtctcatgcaaattaatgtgtaattacatttagatggcgcagctgctctgacactctgctcccagcttttatttctgagtttcaaaggtttcataaggaaaccttgaaagaaaaaagtaaatattttgaaaaggagttacaatttgtcagcagtaatccttccctggataggcaaagaaaggcaaatcttggtagatgagagaattgtggcttttgaaaataatagcattacactgaaatttaatctgctagcgttattttttccaagcaaaccctctttgcattcaatttgtcatttattacagtaagaagcaacagggtccaaaagagaattgtttgcagtaagcacagagatattctcaacaaaggtagaatttgatagcatgcacaaaacaacacattacttatccagcattctgagtcaccttttcagcaaagaaccttgtgtatttgatagcaaagggagaagaaatcgtgtttattggaatgttaaaatgcgtgatagggcggacattctattttaaagaaatatgagactggaatattgattctgccacatacgaaggctggaaagtattcataaatgatcaattgcctatagtttaatgacggaagataggcattggtttcccaaacctttttatgctacaacaaaaccgcacaccaagccctgccggagggtgctgtataatcatcagagccctttctgagtatgtcaggatgatgcgccctagtgctgaaagatggtggttacatgagcaacagaatgctagttagcaaggcaatgaggagctgaggtccacattaaccatggtcggtgcacctaatcatgaatcacagctgtgccacccttggcagatgaacaatctcttacagataagacaaattttatctgggatcagtatagtcttttaaatgatgtatgaaaccaatttaagaaaggctgagttattccaaatagtatggcttttattctttatttgtcagtttcatcattccctccttgctgactattcagatacatgtaaaggagacagccaatggtttggcacatagttggcacacaatgaatggcagagatccttgtttgtgttagtattttgattatttttcttaccacaataacatgacctgaaccatgatcaatctgtctttatgcttccagtagagatcttgattcatagctctccctaatattaatccatttcatattgttttatattatagttaacatgaattgattttgaatcctttcctctagaagtataacttgtttgagacacttacaagcagacattcaattatattcagagggaaaatttataacagttcaggagaggaatttaactgtcatgtattccaccagcaggtaatgtcagcattttcttatagttaaatggcttcatcaagttactctattgctttaattctaggatgccatcaattttagggcacattatcagttgagtctcaattcttttacactcttgaggaaaacactccatttaaggtatggattaattataaatgatatcctggtttagaaacattctaagataaactgcatttttttaaagttgaaattgatagtaatttgtgagcatgacgtaagtgcacaaaatcttacatgctttatggtctttaatgttgacttaaaactataatatcaaaagagaaaaattaacagagcctaattactctcaatttataaaggacaggtttcattttcaatcactctccagttttctcaggtttcttattcagccgtataatgtcaggcaggatactaaccagattaggctttatcctcatatctttgaaaacataagttccataacaaaattttccctagaggttacttccagtattacagcatctaagtgattcattataagcactgaaaagggtcacatgtattactttattcatttaaatgaaaagaaataaaaaaattctttatttaaaaagaaaaataatggcaggccttggccactcatgcctgtaatcccagcactttgggaggctgaggctggaggactgcttgaacccaggggtttgagaccaacttgggtaacataacaagacccacacaccaccccccagccctgccgccccgtctctactactactactactactactactactactactactaataataataataattagttgggtgtggtggcacatgcctgtcgttccagctactcaggaggctgaggcaggaggacagcttgagacaggaggatgaggatgttgtgagcagtgattgcaccactgcactccagcctgggagacagagcaagaccctggctaaaaaaaaaaaaaagtctggttgtttgttttagaagagtaataatgaagactcataaatgatcacagcctaggaggccctacaaaatggctgcaattattctgctgatgttggacaagctattttttaggatcaattagttaattgtgtgttgctttaattacttacactctttttaaagctttctttgtgtcacagctgagctcaggagaaaaagtaaagcttgcagagcaattctttaagtgtggatgtaaaatatactaatggatttacttgctagctggcacagtgtttaaatagggtcctgctcacgctgagaaaaaatattttatcagcacctgactccaaagagtcaagaatatggagaaactcacatttctctcatgatgggtaatttctgggtatgcaaagctccctgtagcagtcattcagtatggatcacttattgcaattttaaattttttttttttttttttttgagacggagtctcactcttggccaggctggagtgcagtggcgcaatctgggctcactgcaagctccgcctcctgggttcacgccattctcctgcctcagcctcccgagtagccgggactacaggcgccagccaccacgcccggctaattttttgtatttttagtagagacggggtttcaccatgttagccaggatggtctcgatctcctgacctcgtgatccacccacctcggcctcccaaagtgctgggattacaggcgtgagccacagcgcctggcctaaaatttatttttaaactacaagaagggaatggcaaagtattacatgtttcttaacatgcatctagtcaattagcaaagcaagtcaatcgtttaagcttttcattgtgtaaagggggaggttttatacacggcaatttgaatggctatgcctagaacacgtggaagcacagagaaatttcaaagattatgaacaatagaatggcactaaagacacttttacaaatgttgctttatcaagtgggttttgttttcttgtttttcaagaaaaacagtcttccttactttaaatgtttttttcccataattctgtttactattgataagaatttaatttaagcaccaatgggcaattatggttttctcctcaattgattatccaaaatgttcaatgaaaaatgtttgcctgtgggtcctctcacatttttgtttataacctatgactcctgccacttccatacaccctactagtctctgcataaaaatgaggtttattgacgattggccatcacttaatacaggtacttgatgaatgtgtgaaaaataatggatgaaagaataaataaatgagtaaaggaatcaacctctatcttaactcagccacaagtaataaacaatctcgggtcctaatggtctcagtaaaaatctatataaggtctcctaacttcgaattattttcttaaattattatttgtccataggtgtggtcataccttgtggccatgttcctgagacagggtaatcggaatataagtggaagtggcatagtctttttccaaatctagctcatgagaccatcccacactacccccatgcgctttgccttcccttctctgcagcttgattatcaatgcacaaactggcattggagctcatgcattaaagatggtggaacatcagtcagcccaggttcctgaatgatagcatgacacagcgaaccctgctgcaattttggcctacagaaacaaggaataaacagctgtcatgttaaggcactgttatttcaaggtttatttgttagagcagccatttttttcttttaacacacgtcctctgctttcactaagttcccactcaccaaagggttttactcctactattctaatgatgtcctgtgaatcctgacccatgggttagatctcagctcaagtgtggcttctcaaagggaaacttctcttcctccttaatgaagtcatttctcctctatattctcctgggaatcacatgaccctactccttagcacttgtccaggaaatcttcattgccgcaaatgttctctccctcaaggtcattgatgaggtacagatgccagtcacttcaggagctgtgggcatcacccaggaggccagggcagcaatgcaggtgagcacttatgaaatgccccttaggacacccacagataactgaaggagatgactgccaatgcaattcaattgggaatatatgtgtactcaaatattaatacagataaagtcttatttatgtcagcaggcttctaaagttttggaaagttcatgtgacctaggtttgccgaataaaagacttagcaacaatatagtcatctattaaggagctaggaaaaattttacaaaatgtctcagcactgatgttcatttgtgagcccaggtagctcagatgcactgtgcattaattttaactgcatgtgtgttttatgccattggatcttcaaaaggctcttattgattggacatgtggtagaaaacagaggcattgataaaaatggaaacattcagtgccattcaagaaatcaaagaaaggaaccaataacaaagttatatttttattttgttatttaattttatttcgcttttttgccttgagggtgatagttattcaccttctacaagaaaattgccttcactttgattccaactagaacgcctggttgcaatggctcattaagaatgttgcaacttctttccgcccaagtagactctcaattctcctctttgctgaaccctgaggctactcatgagggttacatgagtaacccagcaacacccagctggctggcttttactttttgtcgagtaagcatcattcctgcaaggaagcagtcagcgaccagatttgggcaactcaagtttcccggcttctctttttgtttttcatattttgttctcttgatctcttcctgctcatttcttacaacaaaaactttgctctggaggcatggacttcttaaagaattttagagtattttaatgattaaagtagtatacagtattacgaatcttcaattagtgaagcaaaagttatcattagtccacaagctattttagcattctagcttattatcacttaacgatttcaatgtttccttcctgggatggcaataatggcatgtttcattttaatagaacacatgttttctgttcatagtgctgatttaaatttgtccctccttaattaagtcattctatctaatcagctttggcatattttctcatagtaagtatttacccttttgcctttttgatggagtggaaatataccttagtcattcaacttgataggacacaacctctttaacacaaaatgataccaccccaggaagaaccagggatttttatcatttactttacaccatgcagatgcctcatcttagcaagactttcttactttcgaggatatcttcaaatttatctgtgcaagactggcttcatgggtgtgcaacctgtataacacacagagctccgtgcctagaatgttctgacacttggtttgctgttctgatattgccatcaataaattcttaacaatatttgaataaggaaattatattttcactttaccctaggccctttctgtactcaaatacctatgcaaggcaaagatgtagattcaaatttcatataatgctcattgttcagggaaaataggtgtagtcttgtctctttattcaatttaacattgaggtagaaaatacagcacataaaacttaagtgtacactctgatgcatttgtacatgcacacacacacagttgtaaccaccaatcattttaagatacagacattatcagctgatcatctgtctccctcatccttcttcccactcaatctctgcaccttctatgggtaaatattatgctgatatatcaccaaattttgaacttaatgtaaacggaatcgtaaacaatatagctttttgtgcttttttggcattctatttgtgagatttatccaagatctaacagagatgtatttttttaaagccgtataatattcaattatatgaatatatcacaatttatccattctattgcagtgggtgtctgggttgtttctaatatttggttattgtgaatattaactattgcgaacattcttgcacatatcttttgatagatatatgcactattttcttttgggtatataactaggagtggaattgctagctcagagtatgtacttatgtttaactttagtagacatcagtagtgacctttgaatgcatattataactttttgccaagctgtatccatgccttcatcatgtaagatttattttgtcttcaatacagcacgttggattgcttccaatagctcttttaaacgtcacaaccatttgggatagaacttttctctatttttacagatttttttcaatattgaaatttagaggacttacaaccagaccaagatttcagagtctgaaagaatacattgattctagttctgttactagtttagtttccataaatacagcaaatcagctgtatttattgcaaatatatattaatcagtagtcacagaaagaaagagaaagtttcagcagagctccaatccaaattcctggtacatattaaatgcttaattaatgcttgattctgtgaatatgtattaaactgtgactatcctaccgttagaaacaataagaaaaatactcataataaataatctatgtttttctgagcattttaagttattatttacagttctaggaatagcttaactttggactcagttagaactatcatcccaagggcacaagtatgcttgagtttcagtaataagtcaataaaacctaaatatattgccaaaatcttagaatgagaaatcacttatttaacaacttcatttgaggggcaacaatattcttgagacacattttaaaaagaagtgttaacaaggatatatgggcttctgtagagaccactctagccaaatacacatacgctatacatatgagtaattttcagaaaattcaggtaaggacctgaaatccaaattactgcatgttgcagacacttgtcattccaagagtaaaaatgtacaataacattattctcgcttctaacaattagtccaggaggacatgttttctaaactctccatggagccctccttcaaataattaacactgttagaaaaaaattttacccctgagagttttaacctctagagccactgctagcattagtgctccctctgtttacaattgataatgagaacagagagacataatttaattgggagggtaaaggggaatttggaaaatgatcagggtgatatgcaaatgttcgtttatttggggtgaccattgagtgctgtgtcactgtgttagacatgatgtttagtactttatagactttttgtcttctcccatttattcctcacagcacatttatgagacaggcactgtattgtgccccagaggaaggcagtctcctgtatgcaagtctttagacctcttgcttatctgtaaaagtaggccttgggtctggaacacttccttaccaagagatagagtcctcatgacctgcgctggacttaccaccttgtgtggaataactttccctgttttgttctgctggagcctgtgcatcatgtggcacctggtcaaccccactgttatatctatcctcttccaggaggggatgaggtgcttcttctgcagcacagaaagggcacctataggccaattgttctgcatcagcctccaggagggaccttctggctttgggggactgacatgcagtactgacactgacctggcgctgtcctttctctatctgaggagtaaagtactgacactgatctggcgctgtcctttctctgtgtgaggagtaaagtactgacactgatctggcgctgtcctttctctatgtgaggagtaaagtactgacactgatctggtgctgtcctttctctttgtgaggagtaaaaaacatcgttcctttgggtatatacccagtaatgggatggctgggtcaaatggtatttcaagttcgagatccttgaggaatcgccacactaacttccacaatggatgaactaatttacagtgctaccgacagtgtaaaagtgttcctatttctccacatcctctccagcatctgttgtttcctgactttttaatgatcgccattctaactagtgtgagatggtatctcattgtggttttgatttgcatttctctgatggccagtgatgatgagcattttttcatgtgtctgttggctgcataaatgtcttgagaactatctgttcatatccttcccccactttttgatggggttgtttgattttttcttgtaaatttgtttaagttctttgtagattctggatattagccctttgtcagatcagtagattgtgaaaattttctcccattctataggttgcctgttcattctgatggtagtttcttttgctgtgcagaagctctttagtttaattagatcccatttgtcaattttggcttttgttgccattgcttttggtgttttagtcatgaagtccttgctaatgcctatgtcttgaatggtattgcctaggttttcttctagagtttttatggttttaagtctaatataaatcatgctgctataaagatacatgcacacatatgtttattgcagcactactcacaatagcaaagacttggaaccaacccaaatgtccatcaatgatagactggattaagaaaatgtggcatatatacaccatggaatactatgcagccataaaaaaggaggagttcatgtcctttgcagggacatggatgaagctggaaaccatcattctcagcaaactattgcaagaacaaaaaaccaaacactgcatgctctcactcataggtgggaattgaacaatgagaacacctggacacaggaaggggaacatcacacactggggcctgttgtggggtgggggaagcggggagggatagcattaggagatatacctaatgtaaatgacaagttaatgggtgcagcacaccaacacggcacatgtatacatatgtaacaaacctgcacattgtgcacatgtaccctagaatttaaagtattaaaaaaaagacacctgcatgcatatttttatcacaacacgattcacaattgcaaagataaggaatcaactgatgagtggataaagaaaatgtgatgtgtgtgtgtgtgtgtgtatatatatacatacatatatgtgtgtatatatatatacatacatatatgtgtgtatatatatatacatacatatatgtgtgtatatatatatatacatacatatatgtgtgtatatatatacattacatacatctaccatgggatactacacagccataaaaaagaataaaataatgtcttttgcaacaacttggatggaactggagtctataatcctaagtgaaataactcaggaatggaaaaccaatattgcatgttctcactaagtgggagctaaactatgggtatgaaaaggcatacagagtggtataatggaaatgggagactcaaagaagagagggagggtgagggtggttaaggaaagaaaaattatctattgggtacgaggtaggctactctggtgatgcgtacattaaaatttcagacttcaccacaatacaattcatgcatgtaacaaaaaaccacttgtacccctaaagctactgaaataaaaaaaataaaaatttttttttttaaaaaaagcatcgttccatccagtgcctgattgtgttgtgttttccttggtgactccaatattaaaatcaaataggcagaaatgctgatttctacttctgatataggcaagagatgccacttcctccacagtccctactttgcaaaagaagaaactgagtcaaagagtacttaagtgacttgtccaaggtcacccagtgaataagaggttgagattcaataggccagacctattttattcaaaaaaatgggctttaatccacacttttctccctataagcttttcttatgtaacttaccattccaataaagaaggaatgtggaggattcagatgagattgcagatgcctatgtatcaatgagcttcatgaagctttctgttttagcagtatctgttatagcccaatatgctttaaactgaggcactagtgtggcataaagctaactcaaatctatttattgctacaatcaagaggttgacatgctttgagaacattcaagttaaaagaacaggaggtgaaatataatgaaagagaaggatacagaaagaaaggactgaaaatatgattaaatgtcagagaagaattcagaagtggtgttgtagaactcctaagtgctcacacattttcattaatcataccattgcaggatactatgaattgtgatcatctactgcccatttatttttattttgtttttgagatggactctcgctctctgttgctcaggctggagtgcagtggcatgatctcggctcactgcaagctccgcctcccaggttcacgccattctcctgcctcagcctcccaagtagctgggactacagttgcccgccaccatgcctggctaattttttgtgtttttagtagagacagggtttcaccatgttagccaggaaggtttcgacctcctgacctcataatccactcaccttggcctcccaaaatgctgggattataggcgtgagccaccacacccggcccatcacaggtattttctaagttgtaagatctatttcctcattatccttcacacaataaataactacctttataaaatacctaatgtgtgtgaagtatccttgtacatgctattcataactatatcccatcacccatcataattttataaggtaggtaaaactttaaacttcattttagaaacatgatttggagaaaagagaatgcttatgcactattggtgggaatgtgaattagttcagcccctgtggagagcagttggagatttctcaaagaacgaagagttgaattaccatttgacccaacagtcccattactggatatatacccaaaggaaaacaaataattctatcaaaaagacacatgcaccccaatgtccatcacagctgtctgtaatgttggactggataaagaaaatgtgggatgtatacaccatggaatactatgcagccatacaaaagagcaaaatcttgtcctttgcagcaacatggatgcagctggaggctattattctaagtgaactaatgcagaaacagaaaaccaaatatcacgtgttctcacctattagtggaagctggacactgggtacacttggacataaagatggaaacaataggcactgaggaatacaagaggagagaggcatggagcaggacgggagttgaaaagctacctcttgggtacaatgctcacttcttgggtaacaggttcaatggtactccaaacctcatcaccatgcaatatacctttgtaacaaacttgcacatctacccccagaatccaaaataaaagtagaaaaagaaggaaaagatacctgattctttttaagcaatgtggacaaggccccagagcagtgacagtccagggtctggtgctcagatccgtctcagtctaacgattaaccatgttctttccacttgtttatatggcttctatcttattcctctatgctcaatggatctctatacctctagttataaatcccataatgggcagggtaggtatcctgctggctgtgtcactcaatagaaaacaaagagacagaatctacaagggctactaggcccacgcctcacatttgttggccacaataggaatatatacagaggctcttggcccacagcctgctctcctccattgtcacctctagctcagtcctgcactgtaaagatccttgcatacatatctatgcccaccccaggccacaagtccaagctcagttcacatcctccacaaataacgaatacttggctactctcctgagctgtaaccgtgcacacttttgtgcaattcaccattcagagttggactcaggaaaatgactcatgcaggttctgaaaaattggcttgtgccacccacttgcataacagattctgggatcccaagtacctgcaatgtggaatagaaggctgtgtgtgggctctggacaggcaggtctcaccttggccctgtggggaactgcacagcaggaagagactcagagtgaaccgctcaaagtcacagtgcccatggatcttcaagaggtgtgtattgactggatgattggcagaaaaaaggggcattgcaacaaatgagatcattacaggaatcaaagagcccaaatcatagtttttaaaagatttttccttggagttgctaattattcgtaatctacaaggcaacctcagcttattctactttgattccaactgagaacagccaggttgcaatgcctcattaagaatgttgtgatttcttttctgactgggtagacacacatctctagcttgctgaacctgcatgttaccactagagctctgcctctgaaaggcaaggaattgccctgttcttgcccctgctggctctcactctgtggggagcaggcactgcttctgcagggatgcaaggcaagtaatcacacatccttctaagaaccttatatcagatactatgcccatgatgcaacttcctatctatgtcttatgaatgtcttaaagaattttcataaacttgaatgatacaagtgatatgaggttagagggaagtcagaggtggtggactcacttacatttgctgattaaatacatctcagttttctgttttggtaataaaaattatctaaagttcaactcccgggaagggctgcttctctttttccccttctccgtcccagaatggctccaggtacaggaaaacacctactagtgttgtagatgaaatgagaatgaaacttgcattatgctcatcgctgggttggtttccattgcaaggcatggttgttctaatcctggaatgtgccccagtcggtacttgatgagggctagtgggcaggaatcccttttggctgctgcctctactcactttgaatatacttctattttgtatttcctccactcttcctatttttttttaagagttctctctctttaatgcatgtgcttagttcagtccaatgaaaggggaaaggattgaatctgatgacctgggttcactcctagctttactatttcccagctatagaatattgggagtccctggacttccttgagacttagtttgtttctctgaaatataagggcataatgtttgtcctttatacagcatagatttaaagatcaaaaagctgtagtttttttgtaggtcaaaggggctctgtaaatcgtaaagtgcttgcagaatggtgaagtggaaatacggtgggattaacgtttagatgacccagccttaaatccaggctctgccaatgattggttttagattcctaatatttagaatgactagataactttgactttccttagaggtctaataatccatgaaattaaaatttcaagtattcaaaaataatttaaattcaacctctgagtcaggaaatgaaaactgatctctttagatttcaaggttttaaatatgataaagtatacataagcagaaggaaacattggaaatagatgtttcacttgaaatgggcagcttttttagaaagggaaacatacaggatccctcctcatttaattcatgtgttcaacaaacatttactgagcatctactagtaaggatgtagaaatgttcccgatatagttgggagatataaaaattagtatgtttgggagcctttatatcaagggatttaccattcattaatggagagaagctcaagaataactacaataagtgggactttcaaaattgctaccaatgagagttatttttaaaagttccactgggaggtaagaaaagaaggaatatatttgctctgtggcagacttaactgtgaatttctggaagtttcaacgaaaagctggttcatcaagaatgcacggaggaataagaatatgactgtggagtaaatactgggtcgaacctcattgttctacaattttctgagtgtaattccacaaatgtcctatatttcttagcaaacatccatttaattcttttctgagagcacgttctaagtttgggcatgaatatgtctgtgttgacgtgtatatatatgactttgcctgcatctttatatcttttttcctcttttacaaaaattaatatagaaagttctgtcatgatcccaaggtataacatgacagacgcttcaggaggtgtctggtctagttggtgagataaaagccaagatgataattctttggtgtatgccaaatgccatgcatacatgatcccatttatctttcacaactgtgtaagccaggcactgtgactagacccgttctccagatgaggagcctaagtcttagaaaggctgaataacttctactaagaatgtagcttgtatgtgttgggtttacgcctcaggactatatttaacaaatacttaaaacttaccacgtgctttacaaatactaactcctttgttatatctctctaactagtctatgagtagatgcagtcttatctccattttatagttgaagaaattaaggaacagagactcagcaacttgcctgaggtcacacggttaataagtggtacacagctggtgtttgaagccaggcggtctgtctcccagtccatgctcctaaccactctgagggcagcttctcaaatcccgctagattgggcttcaaagccctatggttaatcactgtacaaatggcctctttgtgctatcacctgaacagaaacaaatataacatccgtgacatcgagagagctgctaatccaaccatctgcattcaggttctgcctctgtgctcagccagcctgcctctgtaaggcactaacacacattctttctaccactgacctgcactttggcattctcatcctgtggctttaattaaatgttaacattcatttgcccttttccattgtgttaaagataacctttgcttcctgtcgcgtctagataagcttcactccatgacaggtaccaaataggttcatcttgatataaagtaaagaatggagactctttgatcctctctgctgacatattttaaaatgccagtatgaatatttgttttgtacttacttcttttacggaatgtcaggataataaattatttctggatactgcagtagctgaaaggttcaagtccaaattagtcatactaagtggctttgacccttcctgagagtcaaacagacttatctctgagacacttttgtttctaatagttgaaaatacattatggagagaggtgctggttgggatttagagggtcacaatttgctggtttggaggaaggttataaagaggttttctggatctttactcatacattcactctattggatgggggatggcttcttgctaaagtgagaagagcattagactgagaatcaggcctagattccagcctcatttttgccacagatgcattatgtgagcttgaacaagtctcttattttctctgaaccccagttgctttattgttttaacaattatatttcattaacagtacataattgaaggatgttatctgatttgctcatcagaataaactcatgagatgcagatttgtattcacattttacagaaaagaaaactgatctttagagaagttaagcaatattcccaaggtcataacacagctagtaaaggaggtggagccagaattcaatcgtggggctatccaatttggaaatccatgctcttcaccattatagctacattcattgttggagagttctacatgtttatgagtgtactcattgtcgctttagagatgctgcatgtatctcctaaaaatgtttttggcagatgatcactgtctttgatagcccattgcagtgatgccatctctaatagcatttactttcctagcctcggaaaattagacacccccctggttagtcagggtggttattggcagcatatataaaattatcttgaattttacagaaagaagagaattctctgtgtttctgaattttggtactaggagaaatattatatttttataagttataatgtattagaaaaaggatattttaaaatgtaagagaaaacaagagttaaagatgagcttggaaaaggagaaatggcagaagagattcctctttggaatgcatcttacaacaactaaatatacacagagtatctatgacaataaaacacttcaaaatattagtaatattttatgtaggtgatgggattatagaatttctcatttcttttttctttttaagctttgctaaattttctgtaatacatatgcattgtttttgtgctaaaaataagtgaaacacacacttatgtacatgtctgcagcaagcaaacaataaaccatctagtagtcttaggctagctaacatcccagacagcaatttgtctatggcacatatctagactaggctaactgcccaggttggtcacatcaaaaaacatatgtccctttgttaatctctctgatgtcatccattatttccaacctaatttcatattagattattagtgcaaggctttcctaaagcaatacacctcttaaatgattacatgacaggaagtcttcagactaagagcctattttaatcagttatttccacttctaaaaattatatttactttctttttcattttcttttttttttctccttttttctttttctttttttttttttttctgagacatagtctggctctattgcccaggctggagtgcactggcatgagctcagctcactgcaacctccacctctgggactcaagccatcctcccatctcagcctcccaaatagctgggactataggtgtacgccaccaggcccacataatttttgtattttttgtagatacggggttgtgccatgttacccaggctggtctcggactcatgagctcaagtgacctgcctgcctcagcctcccaattacagggattacaggtgtgcgccactgcacctggcctatatttactttctagtcattgaaatagatcaagttttttcaatgcaattaatgaaatgcattatcctttatttatgctaattttgtcctccattccatatgtctagaccccttgtactaatttttggctatcccacagtttcgtaattggccttactctttctcatgattcaccagccataggcacaatgtcactagactactctttctaagatacatcaagtgggtcaatgcagtctttgagaatgtatggtatttgccccaatacctataatcccctccaaaatagcagacaaaatagtctcttcataacctggtcctctaagtttggtatcaaatcacatttccttgatcttctaacatgcttcaaccacacctgcctttctgccacatggtcatactttactcagcccctggccttctgctttgattcttatttttttctggtcattgacggtctttttttccccttctgcttattttctttctagtgttatctcttcctaaagccttctgcaattaccgtgcctattgaaattgctctttttcatcagtctttagtaattaaactcttttgtattagtccattttcatactgctgtaaagaactgcccaagattaggtaatttataaaggaaagagatttaatggactcatagttcagcatggctcaggaggcgtcaggaaacttacaatcatggcagaaagcaaaggggtagcaagacaccttcttcacaaggcagcaggaaggagaagagcaagcaggggaaatgccagacacttataaaaccatcagatctcataagaactcactctctataaagagaacagcatgggggaaaccatccccatgttccaattacttccacctggtcccatccttgacactcagggattataaggattatggagattacaattcaagatgagattttgggtgggaacacaacaaaaccatatcatctttactaaatatttattgttgttttttaactaacacataataatttacatatttatagggtacatagtgatgtttctatacacaccatgtatagtgatcagatcagggtaattaacatatccgtcatcttaaaacatttatcattcttttgtgttgggaacactcagtatccttctaactatttgaaactaatatatcattaactatagtcatcctatagtgctataaaacactagaacttattcctcctatctagctgtaattttgtatcctttagcaaatttccccctacccctctttccccaacactcttcccagtctttacaatcctttgttctactttttattctgtgagattaacttattttagcttccatatatgaatgagaactttctgttcctggtttatttcacttaatatgatgcccttcagttccatattgatattctgtcatttagtaagatttcttttattattctctaggtcatatctctatctatctatctatctatttatctatttatctatctatctatcatatctgtatgctgtggctccccaatatggctgttagttgtagaaaggtaggagtgtaatctgtatattgtattttctttttatccctatcagtgtcttgtacagtgttgagaatatagtaggtacttgataaaattttgctaaatcatatttaggttcgtgataactgagtttaatcctccaccaaataaatgagatttcgtcattagtaaatcaaattttaagtacaaagatcatttaatttttaaaaagttcaataattattcacttattttatctgtttttgactataaacagagcattgttcatgctcaaatgcttaactggttgaaagaagctcttcctctgacaacttcctgtcaaacggttatttaaaactctcaagtgtgttgctctaggagaatgacaccacggtgatttaacatgggatgatgcctaaacaatggatgacagaagagttattaacaggaagcaactatattgcagtgtcctcaaagactcctaaataacaggaaagttatcttcactcaactagctgcctggtaaagactgttgcctcattaacaattgttgcctcttttattttactgcctttatttttcttttactatactttgctgctgtggttattaaactgccaaagccagtatggaaggaggagctgtgttttggaacccagtgttctcatctgcattctccctcagcgagattttctgtcatcaaattagcctagagaaatagcatgctgattaaaaataagctttaagttccattgaaagctagaagtctattatttgcctagatccaggcatagaaaggaagacactcaatataaaagaattaccagttacattctgatttccattgtccttttaaagttaaattatttaaaaaatcttatagcagaaaaatggcttgaagtaggttttatctaataacttaggtggataaacaaaaaaaatcaatttgatcattattgcccaatattgcgtcttatgtgcagaactttatattactataaaaatttattttagtattccttccaagtatccactgaaagagctatatgttttccctccttccaccttcagcccatgaagacagatcctattttctcaaataatttcttaatgtttaatgaataattaaactgaatttcaaatatgtaaagagctaaagagatctcatgagagttatggacagaaaccaccatatgtaaaatgcaaaaaaagattaaaatttatcaatggagaatgatcaacactgaaactgatgatgcccacttatatattttttagaatttttagaaattaattgaattttatacttgaaaaataaggatttgtaagcaatattaagcaatagtgaagtttagctctaggtttagaatcagagaaactgaatttgacttctagtgacataatctcttaccaggtgataggttggtcatgtgatatctttttctgattcttaataatgaggataatgtcattcttacttttttcaccaggtgatctttcagaataagactgtgaaagtagtttgtactcataaggtgctctagaaatgtaagttattatttctcccatatctattgctatataaactgtgcactttaaagttttatctatatggaataattctaccctatgagaggggctcccaacccccgggccacagacctgtaccagtgtgtgtcctgttaggaactgggatgcacagcaagaggtgagtgagcattactgcctgagctctaccttctgttggatcagctgtggcattagagtctcataaaagtgcggacccgattgtgagctgcgtatgtgagggatccaggttgcatgctccttatgagaatgcctgatgattgatgatctctgaagtggaacagtttcattccaaaaccatccctccactgtcgcctaggtggaaaaattgtcttccaggaaaccgattggtccctgctgccaaaaagattgggaactgctgccctatgacatctaagaaagcaaagctgtttagaaagaaaacatagtagtttatgctgggcactagctatatgctaggcattgtgcaagcagtatttaacttcatcttcaaaataaccctctgagttagggacacaattatatccggtttacaggtgaagaaatataagcccaaagaggttaaaaacttgcccaaatcagggcataaatagtagagtcagctgcatcctagattttctccaaatgctgtccccttccccaccatattgcattggagatcttttctttcatcacaggatttataaaagcaaaagtccacttcagggaggagccaacccccttgataaagacatgagggggacttgcccatcaacaaagaaggtgccagatgcttccctctcagatggccctggcagcatgcctgttccataaattgcctcagtgaggcttctgctactacatccctttattaaggcctttctgtgattactctgctgctttctttccaatctctcagataaaagagcaaataagcagatgaaaaatgcagtctaaaggctgagttagaaagaaactgcactatgagaagcagggaaagtaactaatattttctaagtcactgtcatgtctctgcttctaagttgtcttaatccattcacaacaatttcctagagctgtattattattaccacttttcacagaatacatttgcactcaaaaagattaggtaatttctcttggaacctggtttgattcaaattgtttccaaagtctccctttgtgttattacaatagaatgcaaaacaaggaatgaagtacagtgtaagttattcattatcaagagggcttcgtcagtcccaaaagggtaaaacattgtttcacggttgtcttcatctgtttggattgctacaatgaatatcacaaactgggtagcttctaaacaacaggaatatatttctcagagtactacaagctaggaagtccaagatgaaggcactggcagatatggcatctggtgagggcccatttcctcaccagacaccttcttgccatatcctcacctagtcgaagggctgagggtctctttaaggaggactgttttataaagtcactaatcccattcatgaggactccaccctcatgacctgatcatctcccaaagtctcgactcttaataccattacagtgggttaggatttcaaaatatacattttggggaaacacattcagaccactgcaatatctaaaaatctttctcttgctatgtgtaaggcatagatatgcatatagcacataaacaaatatacagtatacatggggtattaaaatttcattggagaggtgattaggagaaaacatttgaaaaagctttttaggaggacaaggatgaaaaaaggctaagaaacacaggtgtaaagaaagaaataataactaaagtgaactaaacttgcagggattttggctctcatcaaggtccggacgaggtgcatgctgtttctccactgcgtcagccatgggagatatcatcgtatattttagagcacatgaggcaaagttgggggcacttctcaaaacctggtgaaattccatcgaatccaatcaaagtccagaagaatcagcactatttttctttctttctttcattctttctttatttttattttattgattgattgattgatttttttgagatgggatcttgctctgtcacccagcctggagtgcagtggtgtgatcttggctcactgcaacctctgcctgccaggttcaagcaattctcctgcctcagccttccaagtagctgggattacagacgcacaccaccatgcccagctaatttttgtatttttagtagaaatggggtttcaccaagttggccaggctggtctcgaactcttgacctcaggtgatccacctgccttgccctcccaaagtgctgtgattacaggcgtgagccaccatgcacggccgaaagcactacttctaaactgttaaactcctagaatcaagcaatcctccagcctcagcctcccaaagctttgggattacaggcataaaccaccatacccagcccaagttattttcagttaaagaaacacagagaaatggtttggcccatgtatgggcaaaccaagtctttgctgtgctcctctctccacacacaacgttctaccatcacatcacaacctgcctttcattctttcatccgtctcccaggatggagtcagcccctagattcatgcctcaaaaaatccttgatttctccacctcacattcttcttttgcctcttggaatgtcccatgtctgcacagagtgtcgtacagcccagacactgcatttacaaagacctggatttgaattctgactctgcaatgaatgactgggtgcaattgatatatcctcttcttatgcctcagtttttccttatgtaaaatgggactactgatttttaccttatgagacagtcatgaagagagaacatggaagccatttagcactgtgtctggtcagtagtaagtatttatttgatgttaatataccaggaattttgacaactaagttattctcttcttagatctgaaacaatgtgtatgtgtattacatatcaaacaataaacatgtgtgagccatgaaaaatcataactcagatgacatctccttcaggaaatccacatccatatccctgtctcctctcatctacctctgagctggtatacctttcttttgttgtgttctttaaactgtgttataaatggtccgtttacgttctgtctctttcattaggctgacttccccgtcaaaaaaaattctgccttatgaaatttcctatttttactacctaaaataaaggtttttcataacttactgttaaatgatgaatgttggtgatatgtttccactagtttgattacctgtgttgcatggatgtagcatatattttcatctttgtcagaaagaattttatccctgtatcttaaagctgggacaaaaggccttaccattgaatacaatcttacttctgttgatttaaaacttgactatatatgttaaacctcttaatatagagagaggtatatatgaaatttatcttaaaccataaaaacctacacagtttatacttctttcttatttcaggatgttttctcatttattatcagtctgtttcatataccatgcataattccagggagagacatgcaggaggtaatttctttctatcctttcttgggcttcacagctaattttagcaaatgcatttggcaaactttttgtagaggttcatagtatttattttgcaatttttcattatgagtttcaagagcacaaaacccaaatatcagggagaagaatgcatactgatatcagacatgcagtgttcactagtagcccttatctactgaatcgtaacagcacttaatcttataggtacatattgacagccaatttatctaattactcacattcacaaattaattggagtgataacaggatatattatcctcactctgacatgtttttggaggtcttcagggagacttatttcttgaaacaactgaactcttgaagtcgtttaaaaggatctgatttataatcatggcttagaacgtatcttcattcccttgctgtcctttttttttcaattaatgaagatacttcaattagaaagtcatacagctttgttggaatgacaatgtgaaccttttcatggttaagctcaatagccaatgttacaatctacacttctttgagatttaactaaaagacatattcattgattcaagcaaatgcgtgttcttttcctagtaacactttcttctttatcctttgaaactccatgcaaatgcaaacatcactttctcagaagcctttctggactccttccatatgtgatgaggttggaagcttcttctctgtgttcacctggaactctgtgcatgctgggcacattataccatttcactgtgatcttttatctcttctgttgttaagcaacagatcaaggactgttgcctggcacatcttacaggataggtactaggtcagggaaaagggataaaaatcagaaaaaaggggacctttccttgaggaatcacattttactaggaaatacataaaagtaaactagcaattaaaattaaaggttaaagtctatgaccaagatattctttgttgttgttgttgtttgtttgtttgtttgttttgagacagggtcttgctttgtcccccaggctggagtgtagtggatcctccatggcctactgcagcctcaacctcctagcccaagccatcctcctacttcagcctcccaagtagctgggaccacaggcatgtgccttttttagagatggggtcttgctatgttttccaggctggtcttgaactccaggaatcaagcaatcctccagcctcagcctcccaaagtgttgggattacaggcatgagccaccacgcccagcccaagatattttcacagttcaatgaatgcaaagggcggttgagaaatgactttgcgttggtgcgggtttttacaaggatcaggttttttgggctattagtttgtttgctatgagagataactccatggatatttctgatgtgctattattaaattacacatttaaaaagatagcttaatagcaagcacctgagcagctaatacttttatattctaatgtgtcctcactgtgtacatggccatttgctttcactatatgtaatttttaaaacgtagtttaattcaatatttcctaaacactaactataagtgtgttaattgctgtgaatgacatgaggctgagtaaatttgtcatcttgggaacttattttgagctggaccctgtctacataataggtactatactagtatttgtcctaggccagattatttaattcttgtgaagacacggggaggaagatattatcatttctatttcagagattagaaaattgataatcagaatagttaggtaacttgttcaatgtcacacagctgagaagggggtagaacgagaactaggatcctttcacccaagcctggcttcttgttaaactagtatatggtttcccagaggagtcaccatgctatctagtggtggaagataagacatgaacccaagtggccctgttataagaagactgtcctaaaccctgaataaaccaagaacattgacatttaagatagaaaaatccataaaggcttcatgaagaaggcttcatgcaagaaagtgggaaagatttcccaaagacacggtaaaagggagataggaacatctaacataatctatagtatctatacttctgacaagtttcatactgaaaaataagtaataattactgtactctgaatacctattgtgatttcaattataatcaatattcactgaatgactactatgcatctggtagtgaatgaagctgcattatcttatctacttttcattacgagctacgaagtagatgttattgtatctcattcaatatatgaggaaactgaggtaaaggatttaagtaacttgcccaagcctcacagtaaaataaactgcagagctagcattcaaaacactgtattacttgacctactgttaatatttacgaagtgcttatctctgtgtcagtcccataataagggctcaataataagagttgctaccatttattgcacattattacaaaaggcatgaaagcaagactatgtacaacaatctcaaagaagtctacatggtcgtttttgatgagggattggtgttgggaggagacatgtgggcaaaggcaagttgggagcacaaaagaagaattttcaaggtcagaaagcatttgaccttgatttgagaaacgactatcaaacaacaatggtgttacagcaggccagtaacctgtagaacccaacttataaagtgcgcatttaaaatgcacatttgaaagtgagagatgattgacctagacttggaaagtgattgaacatgagctgcaagggggaaggaagattaaaagatgagttttggggaattgagcttaggtagatgagtgggatatggtggtagattaaattaaatacaaggcaaagagcaataaaatcagccttgggttggggctgggtcaaaggcatggaaggaattaacagaaggaaaatgacaaccctgtttggagaaactttgatttataggagccaatgtggtgtacatctaatgatgttcagcaggttgttaaaaatatgtgtgacttagtatagcccatgagagaaaaggacagggttaattatatagattttgaaatgatacagaactgtgcaatattgctcactaaattattactcattgtgtccaaagtagcttttggtcaccatccccctgtatagtttttttttttaaatttatttatttatttattattattatttttttagacggagtttccctgttgttgcccaggctggagtgcaatggtaggatctcggctacccacaacctccgcctcctgggttcaagtgattctcctgcctcagtctcccgagtagctggaattacaggcacccgccaccatgcctggctaattttgtatttttagtagagacagagtttcaccatgttggccaggttggtctcgaactcctgacctcaggtgacccacccgcctcggccttccaaagtgctgggattacagacatgagccactgcacccagcctgtatagttttatttatttatatttggtgtgctttccagtacctgaaattatgtacaccatatacatttatctttatttttattatcagtattcttcatttcattattataaggaatttatttgacattttcatcactgtatttatagattctagataaaacttggcatattagagggcattcaatgcatacatttcatatgaatgaatgagtatataaatcaatgggtctcagtttttatatccctaatgtaaaacacacattctttatcactaataggccattgatactcctaagaccatgaggaaatctatgcactatctgctcagaaaaaggcacagacactgcaatttctcatatacgtacaaaggattcacagacatctcaaggcccatagattcatctagaatttgagatgcaaagctatgggctcatccagcatttctctcactgtgaaccttgagggaaacctaaacttagggattttgattgtttttataactgatttccaaatatcttagtaaaagtagtgtgatatatatatgtgggagtattaactctggtttctaccctaaagcatgtgggtgtttgaaatacccaaattgggagttcaaattccagagatggctattgcaaatcttgacaatatttttaggacttctagaaatattataaattcgtaaatttaatcaatttataatattgataaatttaattataaattgataaaattcattggttttaaaaactgtggttggcttaaatgaccacaaaagcaacaaaggttgcttttgtgaacaaaatatgcaacccagcaaacccagcagccctgcgttctggaaacaagctctgtggctggggttctgatgggtccatgtatggaagatctctgaaacttagctgtgtgaaaggtaagctgaccctgctgttagaacatgttctgtccaccacagggataaacccttcctgcaaggtgctcgtcaaaaagcctaaatgacagagattggagaccccactgatgtcacagaaagaatggcttgatatgcacatatttgtttgggtgtgtgtgtttgccaaataatgggtggaattattgggtctgatatttgctttcactgtaacataaagagaagaagatttggttaattatatgaatttttgaatgatccaggtttcatgtcctataaagcccaagagcaaagtaagaggtcaaatagccttcaccattcactaatggttaaagcttacaaatccttgccaattatacattctcaaattaacctacattcatttgcaactggttgagagaagaaaggggacacgattaaattgtaaggagacctcagagaaatgggaggagagatagaaaagcaccacaacattgaaaaaacagcaggaaggtttcaagtgggaaggtgtttggtggagttgacaaatgcttcatactttgaaacatataagcactaaggggaaaactttagttttaaaattagagataaaattgattccttttaagaaaaaaaaatcaatagaatggcagtggagtggaaattttcagaaaaagaaatattaaaaacttactgagttcttcttctgtataaaatactgtgtcaggttttgttaggagaacacaatatataagacagattttctgaattttaacaatatttgaattggggatttcttcaactgcaaaaggagatgttatgaaaaatagtgtccaagaataatgaaacacaaagaagttattaattatttgtttggttgctttttcacttattctgttctaatttatttattttatccagtttattcaatctccttttggtaaagtcgtaccaggttctccctttaggtaggtgcttatactccattttcactatatggctagtacagtgactatgtgactatgtgatacataccaccagctctaaccatgggcacaaattgggttgagacaattgatataatgcttcactgataataattgattaagggatgaacctatggctaaattcagggcaataagaacgaggttcaggaattctattagatacctaaggaatagaagttctcacacaccggggcctgttatggggtcaggagacgggggagggatagcgttaggagatatacctaatgtaaatgatgagttaatgggtgcagcacaccaacatggcacatgtatacatatgtaacaaacctgcacgttgtgcaaatgtaccctaaaacttaaagtataataataaataataataataataataaagaagttctctttttttacagttgataggaggaatttaggttcaaaactaaaccttttttgtgctacttgaggctgagcctagaattcccagaggttctcagtctgaaacacagaatcaaagaagaggggaaacaggaattaggtgacattattttagctgctgaattaagcttcacctgaagcttcacttttagtttctaaaagtttagaaatgtctttaaacttttcagctatgtgagttaatatattctcattgttattgaaaccagtttgatttgaattttttaaacttgacattaaaaaaaagtcctaatggagaaatgtctttcagagattctggaaaagccaaggtagggatgaaagtttatgaaggcaaacaatgggctaaatctagaaaaataggttggaaccagcaataaagagccctccaagcctccaaggtatttaaattagctacagattgggcttttaaataattcatcgttcattcctctgtgctcttaacacctgctccttaggcctccagtggttactgatgttgcccagtcatggattacagctcattgttcaaatgtttcttttatccactagattgaatgaaaactcctccagtttttttgagggcaggggttattttttactcaaactactaacctcacatctcctagcataatgcctgttacatagtaagtagttgtagcagggaggaatgaagtgagaacatgtattaatccgttttcatactgctataaataactgcctgagatggggtaatttataaaaggaaagaggtttaatcgattcacagttcagcatgcctggggaggcctcaggaaacttacaatcatggtggaaggggaaggggaagcaaggcaccttcttcacaaagcagtaggagggacaagtgcctagcaaagaggggagagccccttataaaactatcagatcttgtgagaactcactcactatcatgagaacagcacaggggaaccgcacccatgattcaattacctccacctggtctctcccttgacatgtggagattatagggattgcaattcaagatgatattcgggtggggacacaaagcctaaccatatcagagcatcattttggcaactccactctggcagcagtggattgaaaggctggaatgaaataaaaaggaatgagaagagaaggtatgcatttcagtatttcagagagaatggaaaagggctcagagaaataactcaagaaaatgctacaatctgaatctaggcagccccatgaataaaatggagatggccacacgaataagttttcatacagtgatcctttttcctgttcctgttcttttttattcatgtaaagttctgaaaactgttgcccatggtaacattcagtggaaagctgaccagtatttagacacatctatcagatcaaacgttgatgaaaaagccctgtatctttcttttttctagagtcagttctaaatatagacaggatgggctccttagagcaatagaagtgactaacattgagttgcagtattgacaatgtccttttctcccctaaatacaagcaaatttgaaataaaaaataggataaccccaaagagataagtgttttaagcatgccagatattttccagtttttgttgtattttagagtgttgatctcgcactttctgccatgagagcaggatgttcagtaaaaagaggaattagcaatcaaaggaagcactggtcttaaagaagctttaatgcatttgagtaagagatattactttctagagtaaactttagaaataggtccagtatacattgtcatagctgattgagaaaattttctaaagactcagtcttagaaggcagcacatacctcaccctatttataaaatttctttcaattttataaatgttaaggtaatatcctattacttcagaacacttggaaaatacagagaaaaaaacacaaggtgttttactcatgatgtaatctgttcatgcaactactgttaacatgtttttaaatttttttctttagaatattatttacttaaacacaactaagtaaaattttttacactctgtgtctttgcttagataagtcttccctgactttcaatttgtaattttatcccttccctgtccccactattctttttccctagcatgtttgtttttgctttgtagaacttaacacaatttttaacagtggttgtacattttttatgccagtttttcacataaggacagaatcacagttgtgttttgcaatattgcctacccaacaggaggcaagttgttggcatatagcatgcacagaaggtagacgactaaagttttcaggcattgtggtgcagtggtttaaagcagcaggctctgcagcctggcttcctggatttgaaccctttgagaaaggcagaatactggcctcccaaagatgtccacatcctaattcccagagcctctaaatatgttaccttacataatacaaataactttgtgagtgtgactaagttaactatctcaagatgaggaaatcttcttaggatatctgatgggtccagacaaatcacaggggtccttataagtgggaggcaagtggggcagggtcagaaaaaggtgatataatcctggaagcagagagagagcaagatactggaaggggccatgctgctgactttgaagatagaggataaggccacaagccaaggaatgtaggtgactgctaagaatctggaaaagataaggacaaagattctaccctggagtctccataagaaaccagccctgctagcttattttagacttctgacctccagaactgtaacagaataaatctgtgttgtttaaggcactatgcatgtggtcatttgttccagcagcaataggaaattaatatgcctgctttgcatatgaatcgtctcagcagttcaatcattctctctgtgcatcagtttcctcatctgtaaaatgaagaagaaagtggcacctgcctcacagcatagtttaagtccataaatactgcaaagcatgtagaacagtgcttggtatgtcccatgttatcaataaatattaattgctgttgaaagtatatattatcaaacaaacaaaatgacagtcagttactcctttctaattctttaatttaccaatgcaatctatcggtgttaaatttctcaatctttcttacttagttgatgaatagggtgtgtgtgagtgtgtgtgtgtgtctttcttggtatcacagtttttaatttgactgtttagttcatctgctgggaggaggaagagcccttagtcatctttgttctgtggttcacctttagccgcccactccttgcccacattggaggtcacggttgaccctataccagctcctaaggccacctgcttatcagccgaggaatcttctctagtcaacctcacattctttgcatttgggaggaagaaaaaggtgattgcttttattggcctacatctggattccctctttctctctgccttgcttttcagttacctcatcctcagttttaagaatctgcccagcccttcaagatgatgctttgtgttgtccccgtctccatcagtttgggttgccgtaacaaaaatatcacagaatcggcagtttaaacaatagaaatttatttctcacacttctggggactgggaagcccaaagccaaggtgctggaaaattctgtgtctggtgagggcctgcttcctgtcttgtagacagccatcttcttgcagagaggaagagagagcaatcctgtgtttcttcttttttaaataagggcttcaatcccatcctgagggccccaccctcatgacctaattaaattacctaagccaacttacctccccaaagcctcatctcccaatgccattacattagagactacagtttcaccctatgagtttgggttggacacaaacattccacccataacagtccccttcactctacagatattcccccatggttctacttacaatttttcaactgttttttttttttttttttttttttttcagatggagtcttgctctgtcacccaggctggagtgcaatggtgccatctcagctcactgcagcctccacctcctgggttcaagcaattctcctgcctcagcctcccaagtagctgggattatagatgcgcaccaccatgcctggctaatttttgtatttttagtagagacggggtttcaccatgttggccaggctgctcttgaacttctgacctcaaatgatccaccctccttggcctaccaaagtgctgagattacaggcatgagccaccacacctggccccaatttttcaactttacgatgatgcaaaaccatcacaattttgaggtaatgtacagtattcaataaattacatgaagtattcaacaccttattataaaatagaccttgtgttacatcatcttgctctagtgtgggctactgtaagtgttctgagcatgtttaaggtaggctatgttaagctatgatatctggtaagcaaagtgcattaaatgcatttttgactaatgatattttcaattcacaacaggttttttggggcataaccctattgtaaattgaggagcatctgtatttaacacctccagaggttactgatgccctgatcctttatccacctcaggtattcaggttttcatattagtgtcctgattttcatttttaccaggacagtagtcctcaggccagtataatacaaacataaaaaggaagatcctttcaacctaaattttgttaaactcaggggtttagagattgtcttgtgtttgaatttgggctccacaactcttttatccacagggagaatgacgatataccccatattacctaagacaatcccaatttataactatggatccatagttatggatcaatatagttgtgattataactattgtaattattaatggcatcccctgttactcttagaagtatcctggtttttataataaattctataatcgctggatttttgatgttgaatgagtccctttattcctcatctgtaaattacaatgatgacactcctcttataggatgctgggtgcagtaacatgagcaataatcatggtgcatagcagatgctcaatctaggttagattcattgcttttaaataatgactgagctccctaaaaccaagaagaaaaatggagccagactggggaaaactgaataatttgatttggaagaaggtatttaaaagcagtatttagttggagacaagataggcttagtcaacttgccaacggcttaatgccaggaaggcccagtagggtcacagaatctcagaaatggatgaaaccatacttattatcaagtctcttccccctgctcatgcaaaaagcttcaacaatctgtgacaaagccatcacctaattattaatattaatggctaacatttataggacatggtgctaagcaccccaggtggattaccttaaatcttcttcattcgaactctataaggcagatactgtgattgcctcactgtagagatgaagagactgatctatggttgcatgagatttgcaagttcatgtagttagaattcagtatcttcattttgggtggctgaggcaaagggattgtttgagggcaggaagtcgaggccagcctgggcagcatagggggagggagggggggagggagggagggagggagggagggcgggagacagagagagagagaaagggagaaagagaagagaggaaagaaagggaagggaaggaagggaaggaagagaaggaagagaaggaaggaaggaaggaaggaaggaaggaaataattcggtgtcctgcctactagtgagcttttggttgccacataggattttgatgatacaattatgaacgtgaaatttgtatttgaggagttcaaaatgcccttaaaaagtctaaataattgacaagagtttctttattgtaaaggatgctttatttttatggattttatttggcaaatgttacttcctatttgctactagttttttaagcacaatgaaatgctataatatcttgaaacatagggaggacttctgtagttaagaggcaatgatgaaaatgacacattggatactttttccacaacaatctactggtttcagggcctgggagaatgtgttatctattgagaaatttacaatgcaatgaatggatagttaacagaagcactgaggtgtagtgaaaattgttcagggtttcacagacaaaacaacttaattcaacttgatgtgaaatagctgactgtgtgaatttgaaccagtaattttttttttactctgcaccttaggtaccctttctgtaaaatggaagatgggctagattattaacaccttttcaagtttgaccagcctctgattctctgaaatacagcctagattccttgcaaattgtcagtttggcaacaaacggtggtgcttagaaaaagctcagggcattcagtagaattcaattttatatgtcacagatggaagctaattgaaattatgtaggtagatcaagtgtaacaacaaatgcttgcaccagcatgtagcagacctttagcccagaactgcttcagtctgtcaacagcactgagcatgttgcagtaaagttggtaatcatctgtctttcttacagaaagtcattgctgagagcagagttttgttgggtcaaggacaccaggttgcttattttgaaaggaatcatgctcagaatctcgcaaaccaaaagcacttttccaattctgcattaatagatgtttaacttggcccagagcaggagcaacagtgccaaaagggaagcatgcccactaacaagactggactgtggcctgagactttgaagacttctagttttaacttccccctgtctgtatcttgagtgcctgcacctccaagagtttttttgaagcatgcaaatggtctgcctgctctagctccacttcatggctcttctctcttttgtggcatctaatgaggattacctcttgctgcttttgcctgcttgtgtctgttcatttatcttaagttccaggactgtgacttctgcccaagtggtcagcctaaaactgctctctccgcagttaaaaaacaaaacaaaacaaaacaaaaagcaaaaaaccaactagttatcaaaatcaattccattctagttatttattgattgcatgtagtatgctctacactatgcttgaagctgggggttcagaaaggattcagatatatcccttccttttccacatagagctgacatactcctggaggagcggacagatcaactatcctttatgtcaggagatgtactagttttatagaacagagcttctcaaactatatgtagtgaaggatcagttttgttccttattttttttctgtccaattcattgtacagtgatacttttgtaaaataaaaaataacacttatgtgtactgcaacaatatcacattgctgcgattgcttctaaatgcttacattcaatttctgcattttgttgttgtgaatgagtaggcgacaatttgcaaaacagcctgatgtgatttggctctgtgtcaccacccaaatctcatcttgaattttaacccccagtgttggagaaggggcctagtgggaggtcattgaatcatgtgggtggacttcctccttactgttctcatgatagtgagtgagttcttacaagatctgatggtttaaaaatgtgtggcacttcccctgttgctatctctctcctgctctgccacggtaaaacatgattgcttccccttcaccttctgccatgattgtaagtttcctgaggcctccagtcatgcttcctgttaaacctgcagaactgtgagtcaatgaaacctctcttcttcataaactacccagtctcaggtagttctttatagcagtgtgagaatggactaatacacagccccatcctgcagtcaaccactcaaggcagcacttgactgaaacagcttaaataaaatgctgttgaaacacacatgagtacacagttcatcccctctggggtatgagctctatctcagggagaaacaccagggaatatcttttagttctcttcttccttcatctttgcttcattcaaggccaacaactacctccatcttccagtccggttttactttgcttcgatcagattgcactaaacctagtgttctcctcccttccatataacacttttgttcttttgttaatatcattttctccttccgcttatccaatcacactggttcctcagcctggtgctgtccttacactctacactgactccttcagacttcttccaagcccgttgtgatcaggtgaagctcttcacacaaaggcagatagctctgaacacaccattactctgttacactcctggaatgtctgtgcacggtcactcaaggcctctttgatctaattctcacctaaattttcagttgttcttcaccacaatgattgaatccatttgcaatgctgcactgaagctgcattatttgctgttttccacatggatcctggacctacataccttcatgactataatcatgctttttgccccttctgccttaaaacttaccccacatcatcatcatttcccagtgccctgacttgccccactcatccgtcttcacaaataatgcctattccttaatacccagcttcaatgccacatctatcgggaaatattctctagagatcattccacatttgtaataatagctcaatctgctaattcccaatgtatttcattttgcttgttttctggcactaggtagggattgtctgtcttcagctatggtgatttgtaggcacatcacttatcatccatgtaggctctctgaggtcagaattcatgcattacttactctctgtaagtgtctcacacagtgccctgttaatttgattatttattcatttgcaaacacagacgtttttgaacctataatgtgctgttcacatcttaccaaccttataagaacttatcatctattgggagaaatcggataacaaacatagttatcaagctatttggcaagtgcaaagagtgttttgcactgcataatacagaagatggagagaggatgcacagccagcaatgcagatgaccatgtgttcagggagtgtttctttagaaggcatcattggaggcgagagtaaaaagatgagcaagcccaagataggcacctcatagctacctgattgctattctatttgatttgattcctttgcacagttctgagagtcccactcagatttcctctctgagtcttcttcgcatacttacaggcagctgtaatctacttgttgtatacagtttacagtccatttaaccaaccagaatttcaaataaagcagtataagcaactgtattgggttaaatagtgtccacccaacattcatatctacctggaagtcagaatgtaatcttatttggaaatagggtgtttgcagatgaaattaattaagatgacctcatcgtagatgaaggtggtcaaatccaatggctggtgtccttataaggggagggagatttgaggatagagagacacacatgcaataggaatacagcctttggaagacagaggcggaaactggagggatgcagctatcagccaagaaatgccaaggactgccagaaactcccagaagctgagaatccaaggaagaattctctcctggagcctttgtagagttcattcccctgcttgtgctttccaggtttgttctcagacttgcagcctccagaactatgggaggataattattatttttaaatttaatttaagttccaggaaacatgtgcaggatgtgcaggtttgttacataggtaaacgtgtgcaagagtggtttgctgaacctatcaacccatcacctaggagttaagtcccgcgtgcattagctatttatcctaatgctctgcctctccctaatcccctgacaggagagtcaggggagtgggggaagggagcatgttgttcccctccttgtgtccatgtgttcctattgttcagctcccacttataagtgacaacatatggtgtttggtttttctgttcctgcattactttgctgagcataatggcctccagctccatccatgtccctgcaaaggacatctcattcctttttatggctgcatagtattccatgctgtatatgtaccacattttctttacccagtctatcatctatggacatttggcttgattccatgtctttgctattgtgactagtgctgcaatgaacatacaggtgaatgtatctttataatagaatgatttatattcctttggttatatacccagtaataggatttctggatcaaatggtatttctggttataggtctttgaggaatcgccacattgtcttccaaatggttgaactaatttacatttccaccaacagtgtaaaagcgttcctattggggaataaatttatatggtcttacgccacccaatttctgggaatttgttacagcagtcctaggaaactaatatagcagcctcaagagataatgcatgtacatcctcattcttaatttggcctgactatcatagaaatgtcttctcctttattgtcctagatggcttaatttctacagagcgctctgctgattttgcacaaattggaggcatgccaaaattctcttaaagggctatgaatttattcttattttcttaatgcaaaaaaattaagtaaataactatcatttaagttaaaaatattgttttatcacattttccaagtattaaaacttttacattctttgtatctatgtatgttcctcgcacaaagttgttccaggttcagtatacattttgtcaaattgtacccaaggtgctatttcccaaatcatattgcttaactgaatgagtagcgttacttttttatggaaaatatccaagtttgtgaatatgtacagtaaacatttttattaaaatacattgtaaagatgaaagttctaatatttcttaaaactgtgccttggtattgggttggctcttttgtaaaaaaagaaattgaaattactccttttctggtagtagtaggagaccattgggttcttctcagtaggcttatcatatacatttacaggaatatttgaaatgataaaaactctgtttagaaatttctgcctattcttgaaaacatcactgtagcattcatttcatttgataaagatgtgaagccatttgtcaggaggcaagagagagggcggcaaggaacttgaaattgcaataacattaataatttgtggaagctttggtctatttattgttaatgttcaaaccttgtgcacagatgcctgactttcccaatctgtggtcaatgtcaagacatagataagtgcatgcactcaatcagaggaagaaaggaagctggccgatagacaagggcacacataaagtatatgaacaggttaataatgctttctttaatcagctggaattaactgttctttaccccgatgcttgtatttgacaggcggccttgattcaccactgccgataaattgctgggtagaatgaatgcctcagtgctcaggccctgtcatgtgttggagacaaatgtttttgttcatttccctggtaagcacaggtacaaattccttaacaaaggctttaactttaatggtgtaaagtatctgtgtcactctgaaaaaggtgttgtgcacacagaagagaaatgtaatcgatttgttgagttaaaaaaataaacatatatcatgctttaattaagacaaaacattttaatctacctataaaatagttctttatcaatgaccatattgccatggactttatcattgactatacagataaaaagaaggaattcaataaaagaaattgttcaataattgttaaaatgattggctactgggactatgtctaaaataggcaaaatatgtccaaatttaagaatgatttttacatataattcaataattttaatgtatatcaattatgaacaaaatataacttattcaacaaattattattgagaatttactatgtattagaacacttccatagatctgggatttaattcattgctgatgaaattatagaagaatttatttcattcatttattcatatgttcactcagaagcattcttagagcacagaccctgtgcaaagcgttaagagttattcttgccttcgaagaaatttcccagtctagtacagaagatggataagaaagtaattagctaaaatgcaatatgatgtatatgtatatgaggtgcaatatgatatctgtgtacagaagtatcatatatgagatttggtgataacagcacagggacagcagagagaatgaggggattaccgaatgtaggtctgagtgaaaggaccaagggaggtggagaggttcactgagggggcaacacttaatctggaatttgaaggatgatgaaaactttactaaaagaacatcagagacaagaagcattccagtgagagggacaatatgtgcaataaaagagaaacaggaagcaggaaaacgggtcacttgctaggttgatattactgatagtaaggtgttagccaaactggcctgaaatgcaaagaacagagaaataagcaaagatcaagtaagacaaagattgggaaatgtccactgagtttgggatttaagttgtcactgatgacatgtgaaaaagctctttcagtggggtggaaggaactgaagccagaatgtagtgggtggtgagattgtatgtccaaggggggaggcccaacccacatcacctgaacacaaacgatgtctactaaatacttcctcactgtttaacagatacatccatagtattttaatgtaaatacaagaaagaagataatacgaggcattaagaagcaagggtcatagtttgggggagatttctgagtatatttatagaattgttgccagggaaaaggtagagggtgaggattcagaagagagagaggctgaggctcaaggaccagagcccaggagaggtggttaaaaaaccaaagaacaaagatattaaaaatgctggtagaaagataaggcttgaagcagaaagaacacatttctttctcagtctgttcatcaagaaacatttataggacattttctatgacctggggactgtaagatttcttagagacattcataaatcctacctcttgtcactatgcttctaccttaatccactgaccttcaaaatatttttattacattaaaacattattatatataatatagtatataatataattattatatattatataatatatattacactatatagtcaatatgactttgagatatccataactaatatatatcacatataactaatatatattatatattatgtaattatattatataaatattacatataacatatataacatatattatataacatatataacatataacatgtataatatataacatatataacatatattatatataacatatataacatatataacacataacatatataacataacataacatataacgtatattatatataacatatataacgtatattatatataacatatataacgtatattatatataacatatataacgtatattatatataacatatataacgtatattatatataacatatataacgtatattatatataacatatataacatatatataacatatattatatataacatatataacatatattatatataacatatattatatataacatatataacatatatataacatatataaattatatataacatacattatatataacatatataatatataacatacatcatacataacatatataatatattatataacatatactatatatattacatataacgtatataatatatattacatataacgtatataatatatagtacatataacgtatataatatatattacatataacgtatataatatatattacatataacgtatataatatatattacatataacgtatataatatatattacatataacgtatataatatatattacatataacgtatataatatatattacatataacataagaatatatatatgttatatatatattttagtcagaccctcactgtcacccaggctggagtacagtggtgcaatctcagctcaccacaacctctgcctcctgggttcaagagattctcctgcctcagcctcctgagtagctgagattacaggtgcccgctaccatgcccagctaatttttgtatttttagtagaaacagggttttatcatgttgtccaggctggattcaaactccagacctcaagtgatccacccgcctcggcctcccaaagtgttgggattataggcatacgccaccacttctggccatatttttttaacgtataaaataaaacatataaggttaaaaagaaaaccaattatactacaaagcagttatcaaaatattaaaaatacacatgtagatcaggtcttataactactataacataaaagtagtcaatataatgactatttgagaaatccgtaactaaacatatttcagtgtctattggctatgaagtcacaggtgctactaataatactgtggtttgttctctacattcacaattaaatgatatgctaaatttctgttgaggttaatgaaaataaagatggcatgctctttgcacttaggtttacagacccctgaatgctctgatccacctacccaggataaggctcctgtgctgatgggagcttgagaactggctcctggctctctctctctacctcagttcctccactcttatgctcacacacctcattctagttacctcagccttcttcccttttgtcaaacatttggcgagtgcttctgcttcagggattttgcatctactaggctttcttgtgtctacaatgttctccccagatatccatgacttgcttcttcattgtgttcaagtcctcatcaaacgtccctcctcagagatgccaacttgactggcttatagtatgacccactccgtccttctctactcatttaccatgctatatttctcttgacaacactcatttacctaacagcgtatcataaactgtcagcttatttggttagtgactcccctactaggatgtaacttctatgaggcaaggatttctttggcttaacaatatcacagtgactgtcacatagcaagggctcagttattatttgttgaaatagatcatttcaactggctatggaaagtgcttacatgtgaggcatatccattatcctggggcctcagagaggaggaagtactgcttctaggagaaggcattgcctaggtacagtcttgagatcattagagattcaaggaaaggagaaaattgaacatatcagttggaaatatgtataggttctgacctagataaggtctaaagtcatgcttaataaaaataaatggccttgctgggcacggtggctcatgcctgtaatctcatcagtttgggaggctgaggcaggcagatcgcttgagttcaggagttggagaccagcctaggcaacatggtaaaatcctgcctctacaagaagatacaaaaataaaaataataaaaaatggctttatcagtcatactttaatggtcttaattttgcattttatccctactccctaaacttttttctttaaagatcttataagaagcaacccaaaataggcatatataaataatatagatggcaatgtgaatttcacataagcatttaggaagatgagttccattaacaaagaactggactggtgacatttgtataacattgtattgatacaaccactttacttttcataatgtcaatttcatttatttttccactaaaacatattacaaccattcaaatgaatgaatggaaatgcaacttttgagtgactccactgatttttcccccattcaaatggtttttggattcttatattaagcagtcttgagataagcttcattttatgctgatttagagagtgtttcaagatgaaatgtcagcaagccttatctgcaaacaccagatccaataagctatatctggtactaaaaatcagaaattgacacaattttaattagcctccagttagtgaacagatatttaataaatggtcacttcagcttaccttttaagatatacattcaggccgggcgcggtggctcatgtctgttatcccagcactttgggaggctgaggtgggtggatcacaaggtcaggagctcaagaccagcctgaccaagatggtgaaaccccacctctactaaaaaaaaaaaaaaataccaaaaaattagcaggtgcctgtaatgccaattactcgggaggctgaggcagagaattgcttgaacctgggaggcagaggttacagtgagccgagatcgtgccactgcactccagcctgggtgacagagggagactccatcatggaaaaaaaaaaaaaagatatacattcaacgggtacaaattattctctaaattacagccctttgtccttcaagagcatattataaaaccacagaaatgaacataaacagagaaaatacctgaagatatataacaaacggttaatcagtaaataattaattacgtactttcattctttgattctacaaagattacttgatgccagaacaatgctgggtgatgtgctaaggtgctggagatataaacgaaacaagttagacaaggtgcttgtctcatggagcttattttataacgagggagatgaataatgaacaaacacatatataaacgagttcaggcacttacaagtgctataaatacaatcaaataggtaataacataataatgtaattttggtccacatagatctccagtctcttagcgtaaagacaacttaatttaattcctggtcctatcaagccctcacacattaaaagtagctgcctgttaaagaagaaaagagagaagaatcaaatacacgcaataaaaaatgataacggggatatcaccaccaaccccacagaaatagaaactaccatcagagaatactataaacacctctatgcaaataaactagaaaatctagaagaaatggataaattcctcgacacatacaccctcccaagacaaaaccaggaaaaagttgaatctctgaatagaccaataacaggctctgaaattgaggcaataattaatagcttaccaaccaaaaaagtccaggaccagatggattcacagccgaattctaccagaggtacaaggaggagctgttatcattccttctgaaactattccaatcaatagaaaaagagggaatcctccctaattcattttatgaggccagtatcatcctgataccaaagcctggcagagatacaacaaaaaaatagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattacctcaatagatgcagaaaaggcctttgataaaattcaacaaggcttcatgctaaaaactctcaataaattaggtattgatgggatgtatctcaaaataataagagctatttatgacaaacccacagccaatatcatactgaatgggcaaaaactggaagcattccctttgaaaactggcacaagacagggatgccctctctcaccactcctattcaacataatgttggaagtgctggccagggcaatcaggcaggagaaggaaataaagggtattcaattaggaaaagaggaagtcaaattgtccctgtttgcagatgacatgattgtatatctagaaaacctcatcgtctcagctcaaaatctccttaagctgataagcaacttcagcaaagtctcaggatacaaaatcaatgtgcaaaaatcacaagcattcttatacaccaataacagacaaacagagccaaatcatgagtgaactcccattcacaattgcttcaaagagaataaaatacctaggaatccaacttacaagggatgtgaagaacctcttcaaggagaactacaaaccactgctcaatgaaataaaagaggatacaaacaaatggaagaacattccatgctcatgggtaggaagaatcaatatcatgaaaatggctatactgcccaaggtaatttataaattcaatgccatccccatcaagctaccaatgactttcttcacagaattggaaaaaaactaaagttcatatggaaccaaaacagagcccacattgctgagtcaatcctaagccaaaagaacaaagctggaggcatcacgctacttgacttcaaactatactacaaggctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaacaaatggtgctgggaaaactggctagccataggtagaaagctgaaactggatcccttccttacaccttatacaaaaattaattcaagatggattaaagacttacatgttggagctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacttactcatctgacaaagggctaatatccagaatctacaatgaactcaagcgaatttacaagaaaaaaacaaacaaccccatcaaaaagtggggaaggatataaacaaacacttctcaaaagaagacatttatgcagccaacagacacatgaaaaaatgctcatcatcactgaccatcagataaatgcaaatcaaaccacaatgagataccatctcacagtagttagaagggcaatcattaaaaagtcaggaaacaacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggactataaatcgtgctgctataaagacacatgcacatgtatgtttattgcagcactattcacaatagcaaagacttggaaccaacccaaatgtccaacaatgatagattggattaagcaaatgtggcacatatacaccatggaatactatgcagccataaaaaatgatgagttcatgtcctttgtagggacatggatgaagctggaaaccatcattcttggcaaactatcgcaaagacaaaaaaccaaacaccgcatgttctcactcataggtgggaactgaacaatgagaacacatggacacaggaagaggaacatcacacactggggactgttgtggggtggggggaggggggagggatagcattaggagatatacctaatgctaaatgacgagtcaatgggtgcagcacaccaacatggcacatgtatacatatgtaacaaaacctgcacattgtgcacatgtaccctaaaacttaaagtataataataataaaatgaaaaaatttaaaaagtagctgcctgtagaagacaggaggattcctgcattcttttaaacatgctagccatctgcagcagataacagaccccatgtagcaaaaattcctttttgaaatccagtctcatcagcaagttactcaggcaaataattttttcaccagcaattttcccatcccctttagtctgttgatgttgctttctcgtcctgagctttgagtcctgttgatttttcttaagaaatcctagatagggtacaatttattagagaaggcttcctggcttccatgtaacagtgtggaaactgatggcagattgaactggagaacatggaaaaattacctcctaatagtgcagccaactcaaaagtaccttccccagcatttctgaagacaatgcaaaaatatgatgccttataggcagccatgcctcagaacattattgaaacacttgtttcttaaaaatttacatttgctttaatgttgaagtttttcttctcaaagtctactgtaaaaaattaatgagatgcagtcagatggttatccataaaaatgttcatttcattgtaatttataacacaaaaaagtgcaaaataagaaccaaattaggccaaaataaggaactagttagataaattaatatatatccttattttgagtgcttatatactggcatactacagagtcactacatgttttgttgctaaagaatatttaatgacatggaattttgttgatggtagagtttggtaaaaagacaaaaaaaaaggaaaaagaattttctatatagtatgtacagtgtaattcaaattgtatgtttgttcacagaaaaattagtgagcagatatataatcaaaaattaatagtggtcaattgggtaacttacaaagcaacaataacctttttgaggcatttctcaagacttaaaaattttttttctaaagtttatatgggttttctttgcaatcagttaaagatgttattttgaaatgcttcttcttttgagtggtgaacacttcttgaagaggaaatgggttcattctttgacattcacagaggggttagaatcaagtcagaggctaatggctgagtcaccaggtaaggaaggtgtaggcaagagatggaaacatagaaaggggctcatcgcaaactccagtcttttcagaggaataagccagctgacgtgaggaactgctgacaaatgacactaatgaatcatagtggcattgggaattagcttgggaggggaggttaattcatattgtgaagaaatttagtgtgcagaatttgtcattctctaagatgaaatgggcattatttttagttttcttttgtttaaagctctgagtggggccttgaggtaccagctagaagttccagggcttgagtcctaggcctcttttcttggatttgctatcaaaagtggtgtggaatatttatccgcaaaaactgcagtatgctcgtctatatcatgggattaagaatgtcttcttatgttggccgggcgtggtggctcacgcctgtaatcccagcactttgggaggccaaggcgggtggatcatgaagacagagattgagaccatcctggctaacacggtgaaaacctgtctctactaaaaatacaaaaaaattagccaggcgtggtggtgggtgcctgcagtcccagctactctggaggctgaggcaggagaatggcgtgaacccaggaggcggagcttgcagtgagccgagattgcgccactgcactccatcctgggcgacagagcgaaattctgtctcaaaaaaaaaaaaaaaaaaaaaaagaatgtcttcttatgttccttaactctcagggttgttgggagggccaaagaaatgtgaagcatttctctgagcatatactatacatcgataacccaaaacaacactccaaacaagcctacattaaaaaaagaaatctttgctatctgtaaacactgcacttagttaagaccttgagcaaatacaatgcatttttttgagactgccttatcagcggtaagataaggataataatagtcatggtggttagttttctgtgtcaacttgactgcaccaagaaatgtccagattaaatgtcatttctgggtatgcctgtgaaggtgtctccatgtgagattagcattggatcagtggactcagttaagtagattgccacctccaatgtgtttggggatcaaccaatccattgagagtctgaatagaacaaaaaggtagagaaaggggaaacttaccccttttctttctcttgcctgcctttcctagctgggaaattgttctttcactgacaatggactaagatttacaccattggctcctctggttctcagacctttggacttgaaatggaatgaaatcaagggttttcctaggactccagcttgcagactgcaaatcatgaaacttctcagcctctataattacatgaggcaattcctcaaaataaatacatctctttctcacacatgtgtgtgtatctgtgtgtgtgtgtgtgtgtgtgtgtgtgtgtgtgtgtattgcttttttcctctggagaaccctaactagtacaacagtaaccagtcaacaagttgttatgatgattgaatatatcaatttatataatataccaagcagaatatctagcacatattagtgatcaatatttcttatcactaacgttattatcattatcaatatcagatttatagatattattcttaataaagttataatttccctcaaggttattcaaaccagtagctgatatttctctcaggtgtatttattctatgaacagtaataacttctctacaatagaggcctctctttatgatacatataagaaattttcattaatttattgtgatcatcaaaggtacaataaagacttcaaagtagaagctgcttcagttggtacagaaccctttatagaatagtttcacaggtagatcgagttctttttactgtttaaagatagaaatgatgaaacaaatttatattttggtggaaatatctttgttaataattattaagcagatggcattgtacataaagtttgcaaagaagcctactaaaatacagattggcttccttataactgggcttatcctcagtgtatcacagaatggtttagaacctgggaatgtcagcattagaatggggcatggaggttgactagtccactttaatctatcgtatcaacccatttattagagccttatatgcagtaactccagaactagaaactctcagctgtaattatcagttgcattaaatgctttccacagtgcaggaaacaacacataaccaaaatcaagttccccatgtactctggctcttccatagctagtgatatgaagctgttcatatctcttgattgtctgagcataatattactgatgattacaaaaccaaaaatcaacaaaaaccctgtttcttgagagagcatattgcatgctagaggcctcggtgtttggagaaaattaatggtcagttttttggagagaaaataacatgtgccaagccccacaggtgaggagtatagacttcacagcaagatcatcgaatgtctcaaggtaaggagagctcagaaagttgtagcaaacatggataaattgctagtgaggcaagcacttgctgaaatggctttccatagaggagtaagaaaattagcactggcccattcggttaacccaatattttaacaaaatgttcatttttactatcattcatttttaaatttatctttacttgtattgatatataacagttgtaatagattgagggtacacgtgaaattttgatacctgtataaaatgtgtaatgatcaaatcagcataattgggatagtcatcaccccaaacatttcatttttcttgctcgtggaagattaaacaatgctggcaaagaaatggtttcctttcctgccacttttccatgaaaaccaggctatagatggctaaaggccaatgtcactcctaaaacagtttcattataagtcattcagcaatctgaatactttattgttgcatttcagatagacaaatgtttactatccatgatgctatattacaatcacagatattctacatttacaacagtaggaagacataattttggaaaaagctgtttgcaattgactgtggatccattctatttataatattgaatataaacatgctaatactacagagaggaaaatgtcttcccagttgaattccctaacaagctgagacatagaatattaattctgcaccaatgttgatgaattctgattctaaaaatatttcttttaatgaatcatgaaattcttaagtttcaggttcgttgaaacaattagaatatgtttcagtttttagaacaaatgctttattaaaatgcacatttaaatgagacacttctctaagacctgatactttaagatgctaagtcctcaataacaataattaaagcttacatctcattactaataaagtgaaaaattgaatattgcttatgcactattaaaattcaattttattttataaaaaagtattaaatgctactgaatcaaaagtcaacactgattgataatttgtctgcatctattacatgaaagctatggccaaattagggatacaaatagagaaacacatgcctttctatcgtatacgagtaacaacccagggcatgggttttagtgtgatgaagatgtggtctcctatctcagcttcatgacttatcagctatttgacctagggctgcattctttagcttagctttaccttttattaaatgtggccactaatgcctaccacagtaacttgctgtgaggttaaaatgggaaaacacatgtcattttcttgcctttcaccagggagtgagacataaactgtttctctgtagggttactcttatcttaggccttcacttcctgccttggccgcatcacattcctccattataaacactttttcacacttagaagaattttacttgctcatttgttccgatttgggggtaagaagatagatattgcaaatttaaatataagctccatgaatgcaattactgtgtttcatttgcttttgctttgctttttcatttttactcaaacttttgtattttgtgcttctgctgtgactgtcatataataggtgcataagatgaataataaatacttgttgaataaacaaacacgtaaaaatccctgtaggtcatgggtgatacatttttaagaggggaataatattcaaaactaacaatgaaggtcaaatgagaagaagtggaatatgtcagaccaggaactaggaattcaggagaagtgtctggggcaacaccaagaatgagagtatctgggggaagcacgtggcagacagacccaggtgaccgtgcaaatcctctatcgctaacaacaaaagctttagtgaatgtatccacagcattactttgaaattcaaaggcaacacgtagctagggtgtcatctgcaagtagcaacatttctctattgatactataaattattacataaaaactagcaaaggaagacaaggatagtctttagagattttgcaaatacccggaggagttttcttaatgaagaggaaatattccgacatatgacagaaatctcataaccaggtataagcatcctataaaaaaaggaggattttttttaacttacagagctgtacctctgtagaacacgatagctaattctgctgcacattaggcagatgaagagacctgattcttccagtctacagatgggtcacagtcacatttgcaagagtagtctgtcacccagaaatgtggaggccaacagagcaccagcccaggacaccctttccctacacacaggtggcagaaatatgtggccctggcttgctggaagttctctactttaaaaccaactagcttctctctctcctgagtcccaaaagacagactgcctggcagcctcaacagctgttgcaatcacgccagtccagaggggaagagacccacaaaaccttcaaacacttcgaagcttaagctgattttgtcaactagaatttagttttacatgattcatcatttgaaccattactgcaaaatacttatgtgtgctaaaagaaaatctttgaagacctgatgcctaaatcactgaagaaccattatcgatttaggccacacagttgctatgagctgtttttgaatgatgctatttttgcatttttttccctcaagcagcaggcaattttgatacacctactccttgccaggcactatgttagccttagagattggaagggttaaacatagtgcaatgcttccattgtcacaaaataaagatgctgggcccacagatgtaaggtaacagatccaccactgagtaaaagggtttgattgtaaaagttgaaaaaataatgaaaaagaaaaattagttcttcagaaaataagaatgtaaaattggacctaatttttcttttcacaagcactaatagttaaaattctgttcataagtgaaacatagactctcaactattatcatttaaaatgcaattatgaaaatataataagtaatttttcatttcttttttcttttgtctaagtttctctacattatttattaattagttcttgcaaggatctcaagagataaggattatattgctaatatcctggttgtagagattttaataacttaactcaaatcagcaaagttaagattaaaataggaatgaaatgaacaagggaagttattttattgtataaaagaatttcagagttggaagaggttttgtagagtacctaatccaacctttgcattatataaaataagactgtgaagatgagcaacttgtttataggtcacacagttgctgacaggtccaatttcaaaaccacctcaaattactgtacatttctcattgcttctgttagccatccataccagtcattgcctaacaatttaagactagatactgggcaaggtgttgtgattttgtgaaccagaaatgcagttcttgttcattaggactcttctctataggagggtacaataaagggtttgaacattgcaatggaagagcaggaaacttcatgaactaagagagacaggtgtagttcttgttccctagaaataaatcccaatatgcatgcagagggacgatatggcccaggaacatttacaagaaatatgtatatctatatatttatatagatataaatacatatatatatatatacaccacagatggtatatatatttatatctatatatttagatatatctatatatttatatctatatatttagatatatctatatatagatatatttatatctatataaatataaaaagcaaagcaaaagcaatccacaggtggatatatatatatatatatatatatacaccccacaggtgttttttatatatatacaccacaggtggatatatatatatatatatatacacacacacacagacaccacaggtggagatatatatatatatatacacacacacacacacaccacaggtagatatatatatatatatacacacacacacatatatatatacacacatatatatatacacacacatatatatatacacacacatatatatatacacacacacacacacacacaccccccacaggtggatatatatatatgtgtacaccacaggtggagcatatatatatatgtgtgtgtgtgtgtgtgttctgcacagcatgagtacacatgcaataatataaaataatataagtggtaagggccctggtcactagagattgccttctgtatttaaaatgagagcaaccatactcaggcgtacctctctcttgccttgtgtgggcatgagctccatgtcaccagatttgattttttttttccagagacatcaacagtatagactttaggagatggtctaaagctcttagcttggttgctcgcctgagagaagcagagttagaacaagtgaagtctacccagttagcaaaagcacaatatataaagatcgtctttaaaattatttgtgtttaaattcacaccttccccttgggaatcttcgcacggatttgctaattgggtttctctgaatattcagttgttcaccgctgactgactagacttcccaaagccttgataactggagaatttccaaatgctgcatttttttcagccaggcagatggcatggtaatggtagatgtgaacttatgtcctttttccttttatagcagtgcctgagtatctgactgacctactgggattaatttactcttacaataggtgataatagagcccaattccagaagtggggtgctcagcagttcttgctaccatgtaccattttcacagccttaatgtgggaccagagcagtataagggcttaacatatattttctcctttattcaaacattactcctaagtactattattgttcaaattcagctagaaaactgagactcacagaggttagttaaacaactttcaaagtcaaacacctattaaatggttgagagtgactgaaatctggataccttaattttaaaagtcagtgctttcgctgttgtatctccccatgaggccaacccaagtggtcaaccagtaaaaaatttggtaagtatcatgtgattttctctacaaaacagtgaacaatctagtggacaacatttttcttttcagtttaaactagaaattcgtattttctttaaagtgtaaggtagaaatgactagatttcctggtatcttgtaaaggaggcaaaatcaacagtaagaagggggctaatattttcagtctctggggaccaattattacattgggtatacttccattataataaagatagatatacaaacatgcatgcatacatacatacatataaccatatcaaaaacaggcttgggtaacagaaaactaacaggaaaaaaatcctatagtttgaaagggaggtatcgaagttcaaagtagcactctctcttccgatgcattagtgatggtgttggaaatggcagtgggctggggaagggtaaaagcgatggtatgtatgtattaaggttctcttcctctaaccttggaatcacattaagtttcaaatacttgtcccataccctgctaactctatgaattttggcaagcaataaccatgtcaggcctttttttcgttgatcttggtggaaagaataaatgaaataatgtatatcaagtgcctgacagtgtccagcacagagtaggtacccataataatcacttcttctctttcctcctcctttactgattctctgctcagcagtggaggagtttcaaagcatggggcatattaatatggtaagattatttgaagatgttcatttagaatatgcaccagtattttcatttaaattagttcactcttcaaatcagcatggtgctccaaaaggtaacaatgttttggcgatgaatatgtgccagcaacttggattattttaaggcttgtataatatttatctatgaaaaaattttcccctttaaacattcaataagctcatagccatttgcttaagtattccatccaagcataaaagcttcccaatgaacgagagcactgtcttgtgacaaagcttatttctgtgtatttttaataagaaagggttcagaatggtgatttcttgatatccattcaggctttgaaaagagatcttatccaagcaatacattttctgaaagtgtaaagggagtggtaaactgttcagaaagggaggaggatctcatttctttctttttttttttcccccaggaaaaagttctctgcaaaaccacaggtggacataaaagtatccagacaactacactctcgcagagatcttaggactgttaaaaaaaaaaaaaaggaaatatacatatatatgcacaaaattgctgataaccataataaaaataatgcagaaattctccagacttggaaagtttaaaacattatgaaacttcttccttacagttacatagcacaattatttgtgtattcagctctgaaattttcgtcttcacaaatgacagtgaatattctgctgtagcagatgcttaatccattaaataagtgggagtcactaaaaaatccctgtctcatgaagtggaatcctactatttggctgaattttcctctggttttccaggaggaatacgcaggatacaaaatttgatactgacttctttatggtatcaagagtgacagttacataaaaacatatctggtctttctgacttttcaaaactatatttttacttaaattacaaacagaaaacagattttcatgttattggctggcgattttatgggatggaggatttaacagagctgtgatttagaattaattgtttgcttttctaaaaaaaacatagtcaacaactaccctaggagatctgacccagtaggtacttaaagcgaggatgggaaaggctgtattttctttttaaatcttctcagaaaaagtagcaatatatatcaaacatatgttaaaatagtaaaatatatgtaatataaatatatattatactcatatatgtttctatattatatgcatatatttaaatatacatatacaaatatgtatatatctacactgtatctcagaaattatctacaaatatgtcatttatcttgacatgtaaaagtacacatatacagaactgttcatgacagctttttttaaattattgaagaaatagactcaatttgaatggccaccagtggggaatgcgtttaaacgaattatgatacagccatataatggagtgccatgtaactagtagaaacacaatgttagatttatatagttgaaatagattaaataaaagctatccaacaaatctatctatattgttagattatggtatattgtagagtaaggcagaaaattttaggaaaattatacaggagaggagatctttattttcatcttaattccttctctgtgagctaaatgctattgttttcatttgtatttgcatgcattactttttactttaacggataaaacaaattaaaaaatgcacacagcaatcctgatgttcagccagtaccgagaacactgtggccctcatatcatgttaaggtgctagaacaaggtttaatcactagagtgtttgttgctccatcaacctaaaatattaatacaaattttgcccggggtaaaaaagtattcatttcatattaagaatgtttcaaaatattttgtttcaaaacatttttgaaacttaaaatgttttgaatcataaagcaaccttgagtaggtagcctacagaaaatgtggcacatatacaccatggaatactacgcagccataaaaaatgataagttcaagtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctagggactgtggtggggtgtggggaggggggagggatagcattaggagtatacctaatgctaaatgacgagttaatgggtgcagcacaccagcatggcacatgtatacacatgtaactaacctgcacattgtgcacatgtaccctaaaacttaaagtataataataataataataaaagaaatataatgggaaaaaaaacataactgagatgttttgatgttttaagtaactacctgaggtatgtttaagcaacatttaagtaacatgaatgaggttttgtttttttttttttttttgagacagagtctcgctctgttgccaggctggagtgcagtggcgcaatctcggctcactgcaatctccgcctcccgagttcaagcgattcttctgcctcagcctcccgagtagccaggattacaggcgggcacctccacaccctgctaacttttgtatttttagtagagacagcgtttcaccacgttggccaggatggtctcgatctcctaacctcgtgatccgcccgcctcggcctcccaaagtactgggattacaggtgtgagccccttccctcgcccggccaaggtatgttttaagtagactacctgcttgaggtagatttatgatacatacccattatcgtgacaatgaaataaaatgaaatgtgatgagaaagtgaaccattccacaccatcacctaagcagggcagcacacgaagacctgatgtaacgctgacaatgttaacacccctgtgtgatgtccaactaaaaataataaaaaaagaaggtgaaaaatttccccatgctgtcaatcaataatgatgtcatcatgaccctgatagaaaactcagtccaggaggttgatggtactaaattagaaatatccatctttccctttggcaaatcctcttttttttttttttttttgtcgtaagtattacatgctaaccttgtaatgagagggcagagaggtaatggggaccaacagcaaggaccctctggaagcctagagccttgggtcccatcctaaaagataagcactgagcacatcacacttaacctctcagcatttcaactttcctatcatctatgagatgagaataatacttgctatctaccccataaaggggttgaaagggatgctgagaaagtccatggaaagcactttgaacttctcagaagtaagattttacagaagtacaaagcctcacatcaaaagacacactcatacctttctgtgacatcaatgagtgtttcatagataggattatgcataggtctgacgctgaatgtgctttatcattaaaataatttctacggcaatttcttttctttttacctggacatatgaatgcatatgcagccttgacaaatcttatactccttctcagatcactgtgaggggtctctgaggctcatttttggctcaccaagctgtgttatttagccaacaggtataaaatgtggtaccccctacttctatctttaggcattgctagaaagtaatcttctggagaaagaaaagtagaataaatttcagtaggttattgatgacatcatgtgttatggccatatttgacacagaacagaactaattcattcaaactccttgttagcaccaacctcttctgaaattacagctgtttctactgctatctagtctacattattaagtaccacctgtgcactcagccctatagaggaatgttccatcagtcttggaaaaggaatttgtctgctagatagtgttaaaattacatagccattcaaatctttcttcgataccttgaaaatagattcttaatactggctatgtattaaaatcacctgagtccactggagaggagctaaatcataatctctgtggctgcttctgccacacagagatgttttatgagattccacatgtgcatgttaatagcagcactactcataatagccaagtagtggaaacagccaaatgtccatttgcagataaatgaataaaccagctagatatgtgggatgttattcagatgtaaacaaataaatggattactgatatgctacaacatggatggacctcaaaaacatcacactaagtgggaaaaaaagacacaaaaggtcacaggttgtgcaattccatttatatgaaatatccagaataggtaagtgtgtagacacagaattcagatttgtgattgccaggggtaagggagaggtgagaaacgaagaacaactgcttaatgagtatagattatccctttggtatgataagaatattttggaactagattgaaaatgttgatgcatgacattgtaaatgtatatatatgcatacatgcatacattcagacatagatttccaggtgtttacaaagcaatctgtgctaagagtcatggtctagagtttcaaacatggttgttgcaccagtaccattgcaactgtacagtgctggcccagtactatgcattgccttcaatcaccagtgcatttcttaatgcttttcttggtgtgacatagggagcatcacctgaagtactgagcatcttatatgagcatcacctggagtatttgcttgtgatgaatgcatattcccagtcttcactgcagacctacagactcataatctcataggagtaatagggcacggttatgcatttaaaatcattcctccaagttattcttatgcatttcatttttatttttaattgacaaataaaaatgcactacattttaaaacttgaaggccctactttggactttgccttactcttccctatttatcattttttgagctttattcatgacctacctccactgcttaatgctgagtatccattatctcttttaagcttcacaaatgacagcagtcttcatttataggagagaaaattaaggctgagaagaggaaaatgagttgcccccaagagttcacatttagaaactggaaaaacctgtaaccaaactttggtttttctcagaaaactttaaaccctttactctttcacaccttatcccttccaaggaccagttcctggtctctcattgtcccattgtcgctatcttctaatatttccctgtaatcatcgcagtcaccagataatcactgccacccgtccccagactcatcaactgatgaaccactattttcaatcatcttttcttgaaatttccagggctatttgacttcaggtaaagttgaccgtctccactttaacctgttgagaccaagtcagtcttgaatgagctcctctacccccaccctggctgttgcatttaatctttgcacctccctctgcccattttgcccaactatagagggagacgaggccctacctgtgtcccatcccttctcactacctgagcacccttcctcccaagctcatgcccccatccttgactctctccctctccatgaggtctaatatgacctttgattaaacatgcttaaattgtaccccacttccaagtaataacagctaagtttaaaagccgtgttgcttcttctttcttaaatattatcttatacctatcctttgtattttttcatcaccagtttttttcttatctcccctctcctcccaatgctgctctccttaaagttatcaaaaatccatcttcaggccaaatccatttgtcaatgttcagttcctcctcaacacctgcttcatctgacatttaatctccttaaactctcccctccctcagcctcagcctctgggtgatcagtctttgttttctttttctttttatttgtctcttctccagtaagtcccttaaacttttctgacccttagtatctttacctttaaaatagaaaaaaaaaaaaactaattcaggatgttgttatagaggctcaaccaggcaaaacctactttgtgtatgtgctcattgaacagacatttgttgcacatctcttgtatgcacagtactgagttaaacactggggtataaagatgacattgacgcggtccccaatgttgaagaactgtaaattgacttgaagaaacatgttgacaataacccggatgctttattcattcatttattaattcaattaattttgatcaagtgcctataatatgtcaagcagttatccaggcactgaagataaaacagtgaaccagtctgaataaatcactgcccttgtgtagcttacattttagtgacaagaaccacatagcaggctagataacatcagggaacataaatgctagcaaggtaaaaaaaaaaattaggataataaaatacagagttgtagcagtgagatgtgctagaagtggggtaagaaactacttctatgtggaaatgacgttagtccaagtcctaaatgatgacaagaagaatcagatattgagaaagtgtgctatatgaggaggacactgcaagtacaaatttcctggggttaaaatgaacttagcatatcaaacgggcagaaaggaagccaaaggagctttctgaacagtgaagagaaaagtggctcatgcctgtaatatcagcatttggggaggcccacattccgggatgatggcttgagccaggagtttgagtccagcctgggcaacataatgagatcccatccctgcttaaaaaaaaaaaaaaaaaaggacaaagacaaagaaaaaggcaggcatggtgcacacctgtagttccagctactggggaggctgaggtgggaggattgctggagtccaggagcttaagctagcagtgagctatgattatgccattgcacttcagcctgggtgacagagtaagacagtctcaagaaaagaaaaaaaagagagataagtaagagaatttggagaggttttggataccatgctaattaaggagtctagatttaattttaatgcgaaggaaagccactgggaggttttaggtaggagaatgtggtaatccaacaaatgctttaaagattatctgaaagctgcatggataattgattgtgctttgggagcagcagaaacaggatgactacttatgtccaccttagtagctcaggcaagagatgatggctgagattgggctgatggctgtggaaatggtgtgaaatgctcaaattttggttgctgaatgtgctttctaaggtctctctatatgcgtacttgttgttttccattttacctatcagaatttatattttttgagcactaggactttgctttggtcatttttccatgccacaatcgctagaacagtgcctgacacacagtaggtgctaaataaataaacatttgttgaattaaagaatgaatagcttgcatgtggatgctgagataaactcttaaatttggtgcttgagcactttcattgacagtgtgtcatcaactgagatgggaaagactaaaaaaggcacaagtttgtgaataaaaagcaagagttccacttttggcatgttcgatttgagacgtctcttgagagcagacacttctatacacatgtctggagctcagggcctgatatttttttcattcattcatgttttgtttccctatttgctgtgaaagcttggcaagaccagggtctccttaagtgtaccccccagacaagtgatatcaacataacctgcaacttgttagagatgcaatgttttgggctccacctcagaccaactgtatcagaaactctaggctgcggggcgtggtggctcacacctgtaatcccggcactttgggaggctgaggcaagtggatcacctgaggtcaggagtttgaggccagcctgacaaatatggtgaaaccctgtcctctactaaaaaatacaaaaattagctgggtatggtggcatgcgactgtagtcccagctactcgggaggctgagacagaagaattgcttgaacccaggaggcggaggttgcagtgagccgagatcatgccattgtactctagcctgggtgacacagcaagactcagtctcaaaaaaaaaaaaaaaagaaagaaagaaaaagaaacaccaggagatgagttcagcattctgcatttaaccagacctgttcatgactctgatgtgcatcaaggtttaggaaccactggtctaaaacactgccagacatagccataagaaagagctgaacatgatttggggcagctatgcaaagtagcaagccgttctgattgttttttcttgcctctcatcaaatctctctttatcatttgaactttcttagctgctttactttgtccttagaatcaaatattttctcttcttttaaattatgtaactatggttaacagcagaactttaaaaaaaattagcctttccaaacactttctcatctgtcacttaattttagcttctgagagctatgaaacagtagggatgggaattctagccccacttcacatacaaatatatgtaggcaaaatcccattaggtgatttattgatgatcacataaatttaggtagatttgagacataaaaaacattgacctcaagctttactcttaacactgatactaccgagtaaacagtaggtgctcaatacatatttaatgactaagtgaatgattcctcaaatagatgctgcaggattcaagaaaatgcaaatttactttatcatgtatgtacgcgtggaaaccagaatactacgtgaccccgaccttttctttaattggacacccacttccaagctctacccatattatccagcaatatgggaattttatgagggaggcagattataacctaaagttatgaataatcagtttcttatatctttaagacaataattgatatagtgtgctctaattcttaatgtggctacacttctcattctgtcaattacttgtgcatttgaaaacagaggtcagtgttccatgtcctgacctctgttttgaattacttgaagaaggcaaaaaactggtgatgctgagactgattcttgccaatgttatctgtctctctttattttaaaacttaaatcgcttccctacccctactggaatgcttttagcctatcgtacccatgataataatgaaacattcctacatttgcataaagctgtctcatttagcttagcttagacacagattttaaaaaacccagtagacattgaaacatagctagaatacggaaacattaatgatgtcaataataataataatagaaaacattttttgaatgttcactatgttccaaccactgggatgctggatgtggatggtaacatttacccgggatgtgaaggacttactatttttcgtatttcacagatggtcaagctatagctcagagagtttaaatacttttcacgtcatactgatagttcatagtgaagctgtgatttgaatccaggactgtcagactccaaaacccatggcattcaccacttttccacttcaagactgtcagcctccaaaatttatggtatgaactactttcccactcctacctcattaaaacaattagcattacatccgtgaatgcctgtcatctgtgttaacaactcaggcaatgagaagactggcctagttcatgtggtcaaatacagtgggtctattttaattatactcatgctccattgggtcacatggacataaatacatctggttagagtttttttgtttatgccttcaattacctggtttaaagcctagtcacaaacatgctccagctctttcattatggtggttggccatctcaagtttttacaccatttaatcctacctccaatctttgtttttcaccagcttctccagtccctttctgccattggctactggttgtatgctggaactcttgttattacagaaaaaaacacattttcagcttctattgcatagcaggcctattttgagcatgatggatacagcaatgaagaaaagcattaccttttctaaagtgccttacggtcaggtggggacgagagacatgtaaacaaataaggcattcagtttttccatattttagcctcagctctttgcaacttgtcttggctgtcaccctgggtgtcagctgcgcaggttctttccaacaaaagaaactcctgcttctccttctatcaaagggaacactatcctgctgattgaaagtttggcaaagcgcccaagactgtgtgtgtgtgtgtgtgtgtgtgtgtgtgtgtgtgcacgtgcgcttatgtgcattgtgcaatgtctaaacactcaaacaggatatttggaacagaactgtgtgattgtttcttatcagacctctttataagtgaccaatttaaagctgaagatgcattaaaacacaggcttcaggtgatcatctgtaatttaaacggagaaggtgagatggtcaggaatttagttctgagagttttgaccttatcatcaatagaaatgagcgtttatggtctttctatttaggaaagagtctctggctttaagcggctatgccttactgtgctttcataaaaggtcaatttgaaacattctgggcttttaatgtaccaatgaattacgggcaaaagcctttatcctaaaactattagataaaaattatatctttagttttgggataatatgaagaggcaaagccttcttcaggggactatacatagctatttataagtattcgtgattgctgtattgcacagtactgttaatttaaggcaaacatttttgcgttgtttaggatttttgaatgacatgcccatgacgtagtttgcgagaaagggaaaacacttggatgtagggcttgagatgaacttcggactcttccagcggccaagtgtaaatgttaggccacatgagcataaacacatctggctggaacttttcttaatgccttcaattacctggctttaagactagtcacaaacatgcaccagttctgatgtccatagtagacagagcttatctactagggtacattattttgctgaatccagagatagtctcagaatccttctcagcacagtgcttcagacattcactgatgatgtaggtaagtgggcccatgagatggaatatttttgtcattccaactataattcaaactcttttcgtttacagaggacaagactgatattcctaatggtgatgtgacttatttaagatcaaacagataagcagtcaagttgtcactacagccaaggatacacactgcttctacttcttggcccaagtgctttgaaaaagggaatcattttaggcaaggagacgttttctgactgagttgtcagctcttcttttcagctaaacatttatattaagagatttccattggcagagccccttctcacccccatgatgatcctagaatttaacagccggttttggagttcactgtgtctaatattgtctgctcttatttttgcagaggctattctatttccatagaaggcttgattataaaatcacacagtatagaaaatagttgtgtaaaaaaccttcaacagaaacactgaagggactctggctttaaatcaatgcttggctttaaatagggaagcaaatatcattgcgtaaaaaagataactaaaatatgactcattgctgggagaaaaggggatacttttgagaaaagatttctttaagattatgtcttacagagctgcttacacatcatacagagtattagaatggtttcattactacaagttaagagtcagattagaataatcattaaaagggaattccctgtattaaaaccaccaccttccactgaatcaattacactcctgtgtcatgaacatcaccaagaatcctagattcaacacagcattgaaagctggcatgaagattatttattaaccttagcattatcccaatttgacttgtcttactaatttttgtttcatccagtctcactaatggtcaccccattctcccagtcactatacccagaaacccaaatattatgttcgacttctttcattctctccctcatacacctaatctattaagtcctattggctctacgtctacaatacaagctagtgccatcaacctcttcccatcttcattattcccccaccctagttaatgctactgtcacttctccccagactataaaataaattacagaatgacagccctgcttctcctctttccttccactccaatttacacttctcatggtggttagactgattttcctacaacctgaatcagataatgtcactccaatgcctgaaattttcaaatagcaactgactgcaatctgaatcaatacaaactcctttagatagcttacaaatttctggaccctgcacatttccccagtcttatctcataatgttcttctgttcactcaccatgctcccaacagatacatcctttcaatattttaaacgcatgctctttcctatcgcaatgacttcccataaacagttcctttttatttattttttttgaaaacctttttcccctttctacacaagagtggatcctgctcatctttcaggtcttggttttgatgtcatctcatcagataccacccctccacaccccatagcagatgctttcaatactctgctcatatcaccttgggttgccctcttatcttcctgaacatgaatattcactcccaactgccagcatctgtgtctctttgttggaggatgaccttcaggcttccagaatgcctttgactgtacatggagagcctgaagtggctgtggatttgtatcccgcttcaccccagagtgcagccttagccaatgactgatggatgaggagtataaatgctccagcttcctggcttcatgatggatttagctctgcaattgaaatgtacttcccttacatcttccctgcaggattgagccagttatcctctgaggatctttgcttgatattgtgttcttatttattctccttccctttctggacctattttttacttccctaccacttctctgggagcaatttctaataaatcacattgacacaaaatctcatctcaggatctgcttctgcaaaagcacgctaagagacaactccaacttttactcaattactctccatcagtgaatcccatttattttattccaagcatttatcaaaaactgttgttatatattgaatttcttgttcacttgtctatatctctcattcaactgtgaacaaactgaggacatggactgtatccttttaaaactagtatacctccagcacctagcacactgtttggacatagtagttgcctaactaatgtttatttttaagagtgaatgaataaataacaaaatccttcctggtccccctgttcatccaggctgaattccttcttcctgctctggtttccatgatgtccatcaagtagcttctgatcagaattcaggttttcatggagcttgactataagggtagcatatcttggtcacactgacatgagtaattggtccatatgataattctccttgttgtaatatgccgttctcctttgagaatacactatatgccaggcagcactaaggtagagacacaatattttattaaatcctagcaaacagctttgtgaggaagatacattacctttgtttttcagaagagaaaactaatattcagagctaaggaatgtgcccaaggtcatccaaatggttagtggcgaaggctgtattagaatccaagagtgactgcaaacccgtgttcttaaccttcatcatgccacctctgttctatgtgaagtttacttagcttcttgagccattctcttgggaataattaagttaaaagactaagcttctgggccttcaaagtagagggccaaatcctagaatgttatgacttatttgagccactactcagctccagctggccttgaccttcaaatcggcaccaccactttctgttcctgccagagccggtgctctaagacaacttgtataactctaaatgtatagccaactttctgtttaattttttaattttattttttgcgacagggtctcactgtgtcatgcaggctagagtgatcgtagctcactatggactccaactcctggctcaagtgatcctcaccctcagccccctgagcttctgggactagaggcatgcaccaccatgcctgactaattaaattttttttctttttttggtagagatgagatttcactgtgttttccaagctggtctggaattcctggccttaagcaccttagactcccaaagtgctgggattacaggtgtgagccaccatgcccagcccaatatatatatacgtgtgtgtgtgtgtgtgtgtgtgtatccttatctgtggtagacattggctatatagccatccaaatcgttagtggtgaaggctctattgaatccaagtctgactgcaaagctcatgttcttaaacctcatcatgcagcctctgtcctatgtgaagtttgcttagcaaactctacacatcccaatttctaccacagagaatggaggctaaagagttgttctgatattcagcaatctacaaataaattttcagctgatggtcaaaagagacaacagtctggaaaacatgaaaagccaaaggaatgacttaggaatagaaataattcactaatttattcaattaatgatatttatccaacatctagatatgccaagtatgcacttgatacaagaaagacaaagcaaaatgagaatcagaaagggtccttacaacactggcatggagatgattagcatggtggttaggaacgtgatgtagaggctgagagttcatgtttagacaactcactgctgaactggaatgcaggctctgtctcttccttactggctgtgttatttaatctgtgccacatttattcctgtgtaaaatgaggatgaaaatactacacccaccatgctcatcaaggtgtcctaaagattaaatgacttaatgtttataaagtttttggagcagtctctgacacatatgatagccatgtaagtttgttcaataaacaaagcagagattggagctaaaataaaataaatgaaagatattatggggatgcagaaaagagaaacttagcctggcgagaaggtgcaaaaaccagaaaaggatcacaaagatgtaacatttaaagcgggtcttaaggccaggcacagtggctcacacctgtaatcccagcagtttgggaggctgaggcaggtagatcactttaggtcaggtgttcgagaccagcctggccaacatggtgaaactcccatctctactaaaaataaaacacttagccaggcgtggtgacttgcgcctgtgatcccggcaactcgggaggctgaggcacaagaattgcttgaatccaaaaggtgaacattgcagtgagccgagatcataccactgcattccagcctgagtgacagagcgagactctgcctcaaataataataataataataataacaacaataataataacgtgagtcctaaaagatggtttggaattcaccaatgaaagaagtgagaggaaaaaaaagagggagacaggccccagcaccagcacaggcaaaagcaggcaggagggaagctactggttgtttacctgaatgtgtttgcataagaagtgagaggatggggagtgatgagatattaggttattgcttaaaaggaattaggacattaagggccttgggaagcaataaagaagtttgacttcatgttatctagaagtaactttaagaaaattttaagtaaaaataatttcacgatcggagttacaaactacaaagtccactctggccacagtatggaagatggcttttgttgagtgaagtcatccacttaccgagttgccagattaagccaggtaagaatgacaggagccttaaataatgaactatcactggaaagtatatttataggaaataatagcaacagacaagccaattttgttttcaatggtcaaattagcagtagttcattttgaataaagttattgacctctgaggcaaagagatagaatcataatggaaaataagttccacaatcagaagtcagcactccaaattaaaagccagtcttcacctatttgatgggtggaaggacacttaaacaatcactgtttgtttctgacttttgaacacatcaaagaaagcatcaatttttatgttacctgagacactgaagaaacaattacatatttaaaagggctaaggaactttgcaaagtgtctataaacaaggtaattattcagaattaattcagtaagaccataataatgattgttacaatttcttgagcacttgctcatttccattgtgctagcaatttacatatattatctcatttatattattatctcacaataattcaataaggtaggtactatcagtcccatttaacagatgaaaaatgggggtttaaagagatttagatactcacttaaatgtcaagaggtagagcagaaaacccaagtctttccacatgtacagagcccacactgataacatctgtggtatcagttctcactgtgaatttatttgaactcagacattctttttaaggaaataaaaatgcaactttacgaagcgtacaatggagagtaaagaggatgcttttcctattatagtcatttttgcacaaattatccttctcacttttcatatactaatgatgttttcactgaggctgagcatttgactaaagtaacaaattattccttaaaaacaaaatgccaaggaaacaaaaaaaaacatgaaaatacattgaggacaactcagactgtcaatttgatagcagttacctgttaacagaaagggttatactatagtgatgacaacttggattccctggatttagccagaatggaatgtgactctcagctctattatttacaaactgggcaaaaacttatggctaaagctaagaagtaaaaaatgaggacgtttgacctaggctaaagtgcatgtggggtgtatctattaggcagaaggagctgcatctgcgaatgtcccaagtacaggtagatcttgtcttaattataaacctacaagtacttcagcatagctggaaaataaagcacacaagatggtgtgtcaagaggttaaaccagaacaatggcagaggccttggacaccatggtaaggagcctgcccatggttttataggggagagtgatgcaatcataatttggctatagtgaggaagaaggactggaaagctactagaaaggtaaggaaacatcttaagacattgccttaacgatccaagtgaaacgtggttagctaaggtcttgggctagtcacgtagtctatgtctcagtttccttatctgtaaaatgagatgacagctgctataatgtaggttatgtgtgagattgaatgagatgatatggtcaaagtgcccagctcagctatgaccactgtaaatagaacgatgtgatgcttgatgaacacaatggatgctgactcaagtttatatttctttcaaatatgactgactcaaaaatgtcatgttgttaaaatttgtccagctagaagaatattcatagtgacagtcctctactgtttaatgtgtattttaattgaatttgtttcttattgaagagtgcattaagctgccttttaattctctcatgacaataataccatggtgttatgtttgactaacctcgggtcctgcatgaataaaggtagattaaaaaaaaaaaaactcttctgacactatgttgaataggagtggtgggagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagcgttgttgaattttgtcaaaggccttttctgcatctgttgagataatcatgtggtttttgtctttggttctgtttatatgctggattacatttattgatttgcgtatattgaaccagccttgcatcccagggatgaagcccacttgatcgtggtggataagctttttgatgtgctgctggattcggtttgccagtattttattgaggatttttgcatcaatgttcatcaaggatattggtctaaaattctcttttttggttgtgtctctgcccggctttggtatcaagatgatgctggcctcataaaatgagttagggaggattccctctttttctattgattggaatagtttcagaaggaatggtaccagttcctccttgtacctctggtagaattcagctgtgaatccatctggtcctggactctttttggttggtatgctattgattattgccacaatatcagatcctgttattggtctattcagagattcaacttcttcctggggagttattcttatactttctatcctgtgtacaatataacaaccccacagctaaattttacaacattataaaaggtcacttttaatgatttaggcctttcatgtatcaatctttctacattaacattttctggaatttcaacatcagagttttcttaaactaagtgaataaatattcaagtctctgtgtattttgaaatgactctttgcataataatgtttttatatgaaaatggagtctctgggtgcacataaacaggttttactgatcttttaatggaaccaactgaagcacagaggcctttaatatcaaacacagtgctctcaatgtttataaatatttgtatagggatgccacttcccgttttaatattttgttactttaacaccagtaccactgtttcctctcattaattagctattgatgttttctaaaattaactttgcagacagtgttcactgacagagttctaaactaatgagtctgactttgtcttgagggaggcagaggaggggaggtggtcacagacatgcaaggagacagtgttgctttctgcttcaacacttcaaggggcagaggaacatttcttttacatgtggcctttgagcctgtgaggcatttgagcaaggaacacctcattcaccaatattttccaaacacattttaaaacccatgtgctaagggttttgatagagatggtattgggtgctatgggaagacacccaagacccacctagtccagtcctggcaacggtcaagaaaacttcctgggcaaaactatggctaaagccaagacgtaaagaatgaggatgtttgacctaggctaaggtgcatgtggggtgtgtctatcaggcaggaggagctacatctgcaaatgtcccaagtacaggtagatcttgtcttaattataaacctacaagtacttcagcatagctgaaaaataaagcacacaagatggtatgtcaaggggttaagccagaacagtggaagaggccttgtataccatggtaaggagcctgcccatggttttatagaggagagtgatataatcacaatttggctatagtgagaaagaaggactggaaagctactaaaaaggtgagaaaacatcttgagaggtttccttaatgatccaagtgaaacatggtttgctaatgatagaagagacagagaagatgtattgagacaaagtaaattaggatatctaatagacagagtttgcctattgactagacatcataagtaagtgtgatgcggactatagctgcccaggtaaatccaaggagtctgtctctatgtttttcactgactccttaatttccagcttgttttatttatttttatttatttatttggggggacagggtctcagtccaatgtccaggttggagtgcagtggtgtgatcatggctcactgcagcctcaacctcctgggctccagcaatcttcccacctcggcctcccaagtagctgggcctacaggtgcatgccaccatgcccagctaatttttgtatgttttgtagcatcatgttgcccaggctgatctccaactcctgagctcaagcaatcctcccacctcagcctcttaaagtgctgggattttaggcatgagccactgcgcccgccccagcttcattttagagtgctgggtgaatactgccacatctcgataacctaaattagaaatttacaggaagagaagaaatacatggctcaaaagttggggggaagaaaaggatggcagctgcatagaaagaacagggactcaagagatcagagctcaaattgggcaggcacaattctcattacctgtatgattttaagaattggttttggttttggatgtgagctaaaaagaaagacagtttggcgaaagatcctaaactatatctacattagttcttccctgttactcttcaaatttagagcaaagcccatttgaatttattgggttgagtacttaactcaataagcaaatcaggtattttgggataagagcatgagtgggagcatttcatactctaggtaaacagtttaaccaccggggagtatcataggctcaaagacttttcaggctctgacggtgttaagcaatacctagcacaatggttcccaaccatttctagtcatggactctgttggtcaaattaacacttacacggaaatccagaatgccaaatataaaaagggatgaaagtggagctgctttggttaaggaaggtatgaggtaccagccattgggcctaccctcagctgccaaggaaaacaattctgcagaacccagaagtattgctaatgtgcagacatacactcagactcgaggagtgctgctgagggttggtaggtagtaacgtaaacgtgttaagatgatagaacacctaaaaccatgctactgattgtaaaacagttcaaaatactattagatttaattcatcaaatagatcaaggtcaactttaactgtagaaaataagagttattatgcacatgataattatgtatgaagaaatacaaagccaccaaaatataatctgccacctttttctggtttctccattaataaatatttgctattagctcattcaattaatttttttccagcacttggaagaagacacattaatttaagaatagattgtacccaggtgcggtggctcacacctgtaatcccagcacattgggaggccaaggagggcagatcacttgaggccaggagttcaagaccagcctggccaacaaggtgaaaacccgtctctactaaaaattcaaaaattagccaggaatgtggtgtgcacctatagttacagctattcagggggctgaggcaggagaattgcttgaacctgggaagcagaagtagcagtgagctgagatcacaccattgtactccagcctggtcaacagatcaagtccctgtccccaaaaaaaaaaaaaaaaaagattgtaaaagaaaattctaaattataaaagctctatccacttattttttccttgtgaaacaggaagtgtttgcattattgaatttagggtaaagagaaggatcttggtctaacctgaaatactggtactttccaataatacagtttgggaaccagagttttaatctagtcatatgatttttaacacacgaaatctgaggcattcaggggtccctctgtaaggtcattaaccaaaccaaagtttattgatttatttttctgtaacagtgtctgacaggttatggtcagagactttccatgtggaatggagacaatcaggtagaaaagatttgcttttcatttctagtactgagctttcagtctagacaaagtaaagactgttggtggtcagtaaaaaggactttcttatgctgtgaaatatagcattttaggagatgcagcattactcgtgcaactgtgttcatctgctttattaacatgtgttatttatgatgctcagggtgccaatgcttatagatagttcttggaaacaattttactaatgttgtccaaaggtctgatggggtccaaaaaaaagaggcctctgggggactgcctgtcacagggtaggggagaggatataaagatgggagaggtcttggcttcataatcacccccaggtgctttggggctacacttccagaagcttgggatcaatgggagaaataaaatccttccgtaaataatgcagtgtgtttctataaggctcgcacacacataagaaggaaaagggacaggaactattggttgaaacaggaaaggaaagtaattatctgctggtttggcagtgatttatcgagaatgggaaagcaaatcattaccaatcaagaaagctcttaggatagggcaaggcagagaggtaaaactattagatgcattcagaaagaatttatgtgctttcttcatcagcaaccccatacattttactgtatttttaaaaaattgtcattacttagaaactgtgaaatatgaagaatgccttcttagtcaagtagcatttttatttgaggtgaactgcattgctagcagtttatttcgtgcagttttatagtggtcaggcacatggactcaaagctggactgctgggttccattcatagctaggtattttttggacattttccttaacctctctgccttcgtttcatcatacataattcaggataatagcagtaccgaccccataaagttgttgggaagtgtaaatgaattattgtatgaaaagctctgggaatattacctagcacattacaaatgctatattagagttggctattattatttattcatatataaaaacaacactaaattataataatagctcatgtttattgagtgcttactgtgagtcatatattttcccaagcattttatatgcaagtcagtcatcagatcttcatggcaaactattagatagagttattattatccccattttacggataaggaaattggcagcaaaactcaggcctggagctctttattactatcccttcatctctttaatatgaatttccttttccagtcttttcacatagtttccttcttcgtgtagagaaattaacaaaatgaatgtactttgaaggaggctaatccaagtaaagaagacttaagacaagctatgcctgtttaattcagctcaacaattcacaccttcataagccatgacaccattctcactgtatttcattttaatgctattattttgcttggtgactggtacatataaatattttatacagactcttctctttgtgccattaggatgatgaaatgtatatatgctaatggaattctaaggttctctgatttttcttttagggtcaattgtcaattatctacagcacaattattgtaagttgaagcaattctttcttccacttttctctatcagtatcgtctttgttgagatgaagcattttagtggcaatagacttactcataacatagctagaattgcagtgtctcattttattgtgtcactgccaaggatgatactggcagattcttaaggtactgctttgttgacaatgtagttgacactatttattgttattcttaattattactgatagtacatcaaaagtggaaaaggacaattgaataaacatatccttatcaatttgacctcttctaagaaatacatgatccccttgacttaacacaattcctggtcaatataagtgtctgccccactacacccccattacctgcctaatcagacctacctactgtatcctctatagcaatttcttcctaattgttgactgttctaatggacagtatgttcggaggaggcaacatggagcaatggagaaattgctgctgagttatctcccacagaaagtctgacttccctcctgtattatcctatctcagtgaaagccatttacattcaagtaggcactcaagccaggatctgagagtcatcttttaacagtgacagtgagaaatgatgactagtaaaggaatcgggggagagtggcttgactcactccataatcctcatcattatactctttccatgatcgttttactttccatacctttattcataacatttcctcaattctatgtagaatgctattttaacatatttaatacagtgtaatatccttatctctccaaattgcagagcttctaaattccacttacactaaaacctgaagctgctgcaattcttccaactttttctcttactatacccaaatcccatgaaaggtgatgaaaggtggatcactcgtttctatatactacagctgtacctcatatacacttctattattgcactttccacacttcatgtatgcatgcacgtgtgtatgtacatatggaaggtgtgtgtctccatttgactggagctctccaagggccaggtcttattcatatctaaatttgaaatacgcaacacaattcctagtatgcagcaggacaggtgtgcttattaaattattgcagaataaacagatgatggataaaagaatgattagactaagggtctgcttgcaggtctcatatgaccttggaaaaaatcaggtaatttctcactgcttaagtttgttctttcattaaaaatacaaattattttaaagacttataataatacatgttctatgaaacagatgctcctgtgaacaacaaactaggatacacttgtaaacccttccacttgctgtgaagtaccatgcctgtgtgtgagaattaaaaattgtggatccaatcaaagaagtataaggacagaaaaactatccttgaatatgttttcaagatgtgtactgtttgaaactatatctcaggtaacaatcaacagttttaagaaagagctttagaaatccaatcacaaagaaaagaatctttatttctccctttgggatatgacatttaacaaattaatttagaattctttaaaaccaacggagctaagaggaaattgagaacacttgtactaatcactcccaacttaaatgtagaaggtcatatatctaaaaggttacattactacaatggagaaattcaattactacggactcctaaagggctttacttaaaatagcacagaactgtaatgctgtcaattccaatgaaaataattgcatttccctaaatactgtgaataatttggtaaatacatctattctcttaaagtacaaatttccaacatctgcagaactcaagagcccaaaacataaatattcaaatatttcatcgagagttttaaatttattaataccaccaagtttactcagctgtttctatacttggatgactgatttttgtctgaagtttagtaaagaggagggtatcttgcttcaaactcactatgaagattgttaatttgattttttttcttcttttaacaaacaattcttttaggaatttcttaaaaattaaatgtgacaatctaggtccatagaatgttaaaatttaaaagaaattgatcctctaatcccatggcactcaaacctaaagccattactcaaatatagctaattctgggccctggtgttaatattcagatcctgttggtcagaattgggtacatttgataggaaccatcattggttctgatatgctgattcatggatctgcatagttatctatagatttctaattcagccttttatctttagagatgaagacgttgagatcctgacagcaaaaataatttctgaaagaccctctggactcttacagctgtgattcaaaacccaggtctcctgacttccagtggagtgctcctttataccatgagacatcctggaaggtcacacacctgggcatcagtgttcagagtacactgttatgagcccatgctgaatgcctctagccacatgagatcacatggattaataggtctataaaacaggaaacctcaatgcgagcaactcagcctagcaaagcagaatgaacaaatgggcactcaaatcatgcaagtgtttacacttctaattatgaaaattgttaacagagcttccctttattaattctcaccacaggccaggtctaaataaaatcaggcaatcctcccaacactcctatgagaaagcctagtgcaattcttattttatacagataaggaggactctgagcaaggaaatctagcataacaataaatagtagatggctgggacaaaagtcaaactcagttctctttgctattttcaccattccccttgtcctttccttcctgttgtagggaaataagatacttcaaggtttagcatttttgtatgaacgttgtagaattccaattgcggaggctttgccttcatgcatgagggtcaagcagtactttactatgagatagaccaagggtgtccaatcttttggcttccctggaccacaatggaaaaagaagaattgtcttgggccagacataaaatacactaacagtaatgatagctgatgagttataaaagaattgcaaaaaaaaactcatgatgctttaataaagtttacacatttgtgttggggccacagtcaaaaccattctgggctacatgtggcctgcaggcagcaggttggacaaacttgatatagaacttcctcaagcaaatggtgccactacattctgtccaaccgggtaacaaaataccctaggaaaatagtagcttttattcacaacacacaaccaggcgccaccttaatccacagtgcctgtgaatgtgaccgtttaaattaaaatgcagtcacaaccctgctgacaccttggttccagacttctagcctccagaactgtgagacaatacatttctgtggtttaagccaccctgtttgtggtagtttgtttcagtagtcctagtaaactgagattttctctttttttttttttttttttgggtagatacagtgtttcaccatgttggccaggctggtctcgaacgcttgacttcaagtagtgatccacctgcctcagcctcccaaagtgctgggatcacaggcgtgagccaccgcacccagtcttttcatgtctttaggtcagattcctcatcattggattctgagatggtaatagtgctgacaagtgctttgagtttgaagttgttcaacttgaccctggtctatgtgtcttacctattttgtttcatgttgcaagcactgctagctttcctattcaatacccatcctcccttctttttttctaatagaaagctacttttgtttgtaatgacagtggcccatctataaacttcaacttcccagactcccttgcaactagaaatgattttatgatatagttttgggccaatgaggtgtaaacagaggtctgctaaggagctctgagaatttttgtttgtccgtttactcatcaattcattcctttattttaatatcagtgtcattccttctttcttcactatttattctccatcctgtctggaacatgaatatgaggttagagttgcagcaacaatgttgagactatggatgataagtgtgataaaagccatatgctaagcacggtgtgaagtcaagatataactctgtcaggacttcagcctttttattgagaggaaaaatatacatatagttaagcaactaaagtaagatttttgtgttcatatagccgtattcaattccaactggcaaataataggaaatcagctgtggccccagagaaaagatccacagataggaacttttcaggctcttctgatgaaaatgactagatttttcaactcatcagcctacagtgaaagtcaccaataaacaaggtctgctcagtcatacagaatgcaatcagcatattattatctcactctgaaatattcatagagagccaaggatggaaaagcagagatcaaaacaaatagtataaggaattcagaggctacagattcagtgcaggaaacaaacaaaaataaattttaaaaatatatttgataccctagggtaacatttttaaaagggtcacataaatggaacaagaataagtagccattgtataataaaagaggaaaacacagtaataaacaactctcataaattcaaagaaaattgttagcagatataaaaaggagttcattaaggaagagtaaaaataaatttaagagaatctcacataaagaaatacgttttagaagtgctgcaaagtcagaggtaaacaattagaaaattgcaatagcaattcaagagactcaatatctgactaacagaatttacagaaagacaaagcagaatcaataaaagagaaacacatttcaaggaaataaagcaaaataattcgccagagttgaagcattaggccgtcagattcaaagggcctatcaaaggcacaaaacagtgaaagaaaagaaatccatactgaggcacatttttctgaattttacagcacctggataaagataaaatgctaaacagcttccagacagaaaaaataaaataggttagatgaaaagaatggcgttctgcttttaaacaagatatgagaatatgaaaaagtaaagctttaaaaaatcggaagaaaactgttctcctaaattccaatataaattataggtcatgtgtgatgagatttttttttaattgagagtgaaaatctttgtaaaaaattcccactttctttcttgggaagtaatggaagacacacttcactaatgagagagcagcaaatcagaagaggatgtggaatgtaacccaagaaagaggtaaagataattctttgttaacttttattttaagttcaggggcacatgtgcaggtttgtcatataggtaaactcatgtcacaggagtttgttgcacagatttttactcaggaattaagcgtagtacccaatagttatttgttctgctcctctccctcctcccaccctccaccctccagtaggccccagtgtctattgttcccctctctgtgtccatgagttctcatcacttagcatctatttataagtgagaacatgtggtaattgttcctgaattagtatgctaaggataatggcctccagctccatccaggttgccacaaaagacattatctccttcttttttatggctgcatagtattccatgatgtatatgtaaaatagcagagacatggaatcaacttaaatgcccatcagtgacagattggataaagaaaatgtagtacatatacaccatgaaatactatgcagcaaagagagttctaagtgagcctgaggagacctagagaacagctgccaatggcaacaagaggaaagtgttaaggagagatgtccccaagggcagaggggagatggggaattacagtttgagattaaaattgaaattggcaaattatacatatacagaaactttggcaaatgaaaacaaaaagatgccatttttactctaaggaaaacaaggtagtaaatgcaatcgtatgctatctagaagaggtgggaatagtattacatgactgtaataatgcaagcccttgaatgttgagtgaaaacatcaggaggttggtgataagggagaatgtgtatagagataaaggggtgttgttagagaggataatcctcatgttccatatgtggaagacaggtaatacctgaaatggaaaactcaaggacgatgagtaagaacagatgtattatgaaagcttatattaggttggtggaaacgtaatatggcttgccattacttttaatggcaaaaaccacaactacttattttgcatcaacgtaatggtagaacaaacagtcaaaagtttcaaggaaattgcatctatgaagcagaattcagagttagggtagggtggcacaagttgctgcttttctggttttcttcttgtgtatttttctgttataggtgaagggtcacaagctttaaggtacaatttcattttcttttttaaaagttcatgtagtactttaattaaagtcaatattaaataaaaatatttggctttggatttactttttgaaaactgagttttggtattggcctattgtttcaccatacagaactttaaagattatatatatatatatacatacatacatatacacacacacacatatatatatgccctacacatccatagtagtaaaaacctagaaacaagagctaatattaaatatattaatattaataatttaatatcaattaaattattcatcaaatattaattcagccagcttctagtctaggcactggtgatacatcagtggacacagtagatggacctccctgttgataacaagtgtatattttgggtgtgttcagatagaatatccttggctaagtcacgtactataatctatttgagccctggcttcctcttctgtaaaatgggcatacaattaaccactcattatttcaaaaattaattatgaggacctgttcagcttaaaatttttttccatgttaagatacaacatctcacaaagcagcactttactattaaaagagttcatttcgccatcattcctagcactagcaaattgaactattagggatgagacctccaatattacactactgccacattcctctttattatgaaaaggcagattgccaaaatcagtttctagtcactcagtttgtctaaatattgcagggctttttgatgttgcattagcagaatatacagtctacatttattccattcttttgtcggcctatgcaaaaaaatgaaatgaatctattcaaaatcaagatgcactgaactgcatatgatgcaaaagaaggattttgctaaacacagcaactatgtaatgcaccccattccttccccatcagcttggatcctgagactattttgtaaatctgcagagataagagttttctatatttattgaaaggtcaaaagtttgggaggtggagaggtgtaaggcaggtaggaatacagtattgtatttattaaacaatatgtcagaaacagacacatagcaggcactttgtaaagtacaatagaaaacaagcacctgttatctctaccactctaatttgcaccatcatttctagtaacagcaaaagcctccaaagtggttttcatacttctacctttcccattcccccatgaagacatccattagaatgatccactgaaaatataaaccatatcataacacttttctctccaaactttcattattttccccaaaagtccaaattttcttcaataacctacagaaagtatttgttaaatgaaagaatcaacccatctagcaaccaccagtgagacttgggtcactagatccttgcaatgtgttaagtaatacaattgaaataaaaagcaattagaacactggaaaacctactattctatggtatcactacatggtagtactgggaactaggacatgtgttgtgagtaaggactggaagttaagagaagtttatgtgggccatagtggtttgggtttcttgcgtagcagagactcaagtgtgagttggagatgtgaatgctccagtcattatgttgttatttaattaaatacaagaaagaaaagaacccatacacctgtatatctcaagtccacagctatcacgtcctcaattctataagatacgctttatcctctctataatagtttaaatgatctatttttaacaaaaaaagttacattttcttctttttttttttttttttgagatggagtcttgttctgttccccaggcaggagtgcagtggcgcgatcttggctcaccacaacatccacctcctgggttcaagcaactctccttcctcagcctcccaagtagctgggactacaggcacgcaccaccacgcccagctaatttttgtattttttagtagcaatggggtttcaccatattagccaggttggccttgaactcctgacctcaggtgatccacccacctcagcctcccagagtgctggaattacaggtgtgagtcaccgcacccagccaaaaaacagctactcctatggatgcagtaacactgcactggaatagacagatacataggtgacatacatggactgaaataaaatctgattgatgtgtcaagtttagagcagtgacagactcactgtgaagatggtagagaaacttgaactccagtaaactctgttatctggaatccaataaattgcaaagtgattaagtggtctctttgcacttaggtacacacctaactgatattctaagtagtctttgagaccctgaatttacacaactcaaggagagattaaattgtgtgcagcatcatgagagtgttgggtttattttattgcattccaattatttgaaaattgataacctgtgtacatatggcaacttcccattgatctgaatattggattaagtgaaacactctgaaattgccaactgaactgattgcacctaatgagatggagatgtggaaatagccatgagcttttcatcaccggctgcaaacctgcaattttcttggtgaagaaagaaaacacaaaatgctattggaaagtggttttcatgtcttgcacaaccccttcatccataaccttcaattctagatggctgcatactgttcacttggctaacttctagaatagagtggtggattctaggcaacaggatgtgatcactaaaaagacataaaacaattctaaaaatgtgttttgaaaaatatcaggtaagttctcataagtgagacattctcagtttaggtaaagcttagaattgtgtttcccaaatttcagttagtcacgtagctacctgtaattgcactagcaaatctacatttaatttatatgttatttgttatttttcttacgttaattcatttaacttacacttaaatacattattgttaaaggaaatattatatcactaccaaactataagtagatatcttttaccataaagagataactacaaatataaataaaatattgtcttcaaatattagttctgagttcaggactgtgatctctttgccaaaagagaaatatacaagcatttgtgatgtgttaaagactggcaccaaaagatgtgtgagtgtgtgtgtgtgtgtgtgtgtgtgtgtgtgtgtgtaatgctgttaaaatttagttaagcttttaaatacatttttaaaattggtatctttactataaggctacttgaagtctataaaatgctaaaaagtattgttattttctcagacaggtttatgttatccagtgtttcacaatatgtgtagagcatgaaatattttttaggcagaaaatataagaagatgcatatttctctcaatgtgtgctggcaaattgtgctgttgcttttgctgtttttcaaattccttcatgcctctatgatactctttgcttctgctcagtaagttagtcactctttcttaaacatgacacagttttcatctccattcttgactcatagtatttccttcactgctgcctcactttcagcggttaaaatacatctctttgccacccaaatacttgcacacaaaatagccaaaaagtgagaacacccaaatctccgtcaactgctgaatggttaaacacgtggcaaactcatagaagggatactatttagcaataaaagactgaattactcacatgtgctactacatcaatgggtcacaaatgctaagtaaaaaagaaacaacaaaaactagacacaaaaggccccattttctatgaatatatttgtacgaagtatccagaaaaggaaaatctataaagacggaaagtagattagtagttgcctggtgggagtggaggttaactgtaaatgggtaggtgggatcttatttggatgaaagaactgtcctaaaattggttagatatcatgattgtacaacttggtatatttataaaaattgacttttatatttaaaatgggtgaatcttttgaaatatacatttttccttcataaaattatgtaaaaatttcagccagctaggtggacaatcaaccacctatccattgacccattcttccatcttttaacgttttctctctcatgccataatctgaaggtgatttattcttgtcttgagaaaacataccattatgttttcatatatcatagatcttttcatttgtctttcttgtatgatattcaaatatttgtctaatatccttactcgaccataagtttttacagacaaactactctgaactagtccatgtgaaaataaatacttattgaatctatatatacatatgaagcaaattctatttcatggggaggggggaggggggagggatagcattaggagatatacctaatgctagatgacgagttaatgggtgcagcacacaaacatggcacatgtatacatatgtaacaagcctgcaccttgtgcacatgtaccctaaagcttaaagtataataataaaataaataaataaataaatcatgctactataaagacacacacacaaaaaaaataaaaataaaaacaagtaaaaatacccattagcacatattattaaattgcctgctttgaaatctgcaatttactggccgggcacggtggctcacacctgtaatcccagtactttgggaggccgaggtgggcagatcacgaggtcaggagattgagaccatgctggctaacacggtgaaaccccatctctaccaaaaatacaaaaaattagccaggtgtggtggcgggcgcctgtagtcccagctacttgggaggctgaggcaggagaatggtgtgaacccaggaggcagagcttgcagtgagccgagattgcaccactgcactccagcctgggcgacagagcgagactccgtctcaaaaaaaaaaaaaagaaaagaaatctgcaatttactttttgttatctaactttgaaaagtggtttaatgcctcaacacatcagttattaattcaaagaatgataataatagcagcaacaaaaggtataagcaagagcagccgcctttactgaacacttactttgaactggccaagctgtttggtacttctcattttgcagatgtcattccagaaaaaagaagctgagacacaatgaagttaaatcaactgacttaggtcaaatgccttggatgtagagcccaaggcaggatttgtatacacatggcttttgaagggagtgctctcaaggcatggtaggaatgagatgtaggaaggtaaaagaggggaagggataggagctaagatttttcaagggaagttttgctctagtctgatccatggagatctccgaggataaacaggaaagcagagtttttcctgtcttaagacaagagaatggacttaaatatacctgttcctgttactgcgcatgtgggtgcccttgtgtgtgtgtgtgtgtgtgtgtgtgcgtgtgtgtgtgtgtagccttggctgtagttacccaaaagtaatcctgcagaaaatgtaaccgacgtgagcacttgggggtgcccacttctgggggatgaacacacccaccgggagaagggattccaagagacctgagcagaccccaacagcctctgctacagctgttggcccaaatcgcatatatagtaaggggaatatctgagattcaaacttcaatagttctgatgcctatatcagtgcctttaatgccccacctttttcaggcagtgccacatttgatacacacacataaatgtacaatatccccattatggcttaggttgatccattagcaaatattttttaaattaaatattaatgcaaactaggataagaaagtcaagcctatttggcacccttctttaatattttaatgaactgatacaaatattttttaattacatgcattatttaaatagtgtctgaggaacttggaggttgcttgaaaaggtctcccaaaattttaaatattccccactccatatcttatttagactaatatatttaaattcattctgtgaatgaagatttgctcagaacctcagtttgaacagtgtgctaatcaccatatgttccaaatgagtcactctgaatttctgaagaattgttatatatctttagttttcattttatcagagataaaaccataaaggcaagaaaaatttgatgttaggaagcagttgatgagccaactgcctcccaaaggaaaacaatgccatgaaactacaatctataaaacaaacaaggccgggcgtggtggctcatgcctgtaatcccagcatcttgggaggctgaggtgggtggatcatttgaggtcatgagttcgagatcagcctggccaacttggtgaaactccgtctctactaaaaatccaaaaacaaaacaaaaaaaaagccaggcatggtagtaggtgtctgtaatcccagctacttgggaggctgaggcaggagaatcacttgaacccaggaggcagaggttgcactcaaccacgatcataccactgcactccaggctgggtgatacagcgagatcctgtctcaaataaaataaaataaacataaataaacaacacaaaagcatggcttgatgcctgccatctagcactgcacaaggagttaccaactttgttctaaagatagcatgacttattgcaataacacaaacactgtgtataagaaatgagacaaactctaaatggaaattgctcgccagagcactcagagcctttgttcatccattttcatccttctcccaatccagcttctttgccatttacatgtagatacacaggggaatttccatgtcctccacttatcttggttaccgctttttttctccttatctttcctattttgaatgccagcctcacagctatcaactttcaaataagtagccaagaggtctgaatacttggagtaaatagaatgtttgattggacaacattgtgtatgcatttcactgagtaaaatgctagtctggatacctgcctatgataaggccaccgttccctattaatatgaagcaacaattggttgagcaggggagaattaacatggccaaacatgttatatagtagacagcacctctaactggtcacatatttaagccacacaatggcaaatggggaaataaggtatatggctttggggtaaaggcaagtatgaggcagagaccaatccctggaagtattttctttgaaaagggaatccttcagagagtgaggcacctcatttctattttaaactatagccagaaacatttctcctaaatgagaaatttgccctagggattcctgatgtttgtcagaaaccgctgtaaatttattttcattcactggagagaagagaagggaggtaacatttatgacatatgcttgtgcttttcatctgttatttaattttcacaagtttttcaggataaaatagtatccttattttgttgataagagaattgagatttagacaaattaaaaataaaacgaaaagaaaagacaaattatagcatgtaaaccaagggacagatcttgaggtaaaatccagaccttttggacctgatgttcatgttctttccattcttccatgcaccctagggcttaatacatcaactcggaaatgtaattgagaggaggctacaaggagacaccattgtttgggattaaacaaaagcaggctgttttgtttactgtaagattcctcaacacttttaaaatgctgaagtatattttgagcttctgggaagggcctacaggacaatgtgtccaaaattttatgaccatagagtcctctccccctggaagcattgcctgactttgaaattctactgaaaatattttagatactactgttgctccagtagtgctatactagagaagagaaaggcaagggctagaatggcttctgtttttatttcatagacttctgcatcgcctgaaatgttgtgagctcacattaatttgggaaataaaataagtatcatttacatgaataaagaataataccatgtacattcccaatagaatgtatttatagatacatgagaagaaatatgtgtgtactaaacataggtccatatctcataattattatgcaaaagcaaaagaggaaacatattcatgtactgtctgatgagtattataatgatacagcaatgaacagagttctgtaaaactgggcactgctcaaagtgaacagcatatgttaactcatttaattatcataataatcccctgaaacatatgtaattatctccatgtgtcagatgaggaacctgggacacaggtaagttaatttacgtctcaaaagtcctactagttacttacgtaaggaagtttgtggaagaacctgataccaagtgtttttctacaaaatttcatactacttatgactcccacataaacctattttgcaaggaattctggaagccttgtgaggacttctgaaacctacataaagactaattagggctcccaggatgttatttttgccttctttaactttccatccaccttatcctgctttttgcactttggttattgagaaatcaaaaaaatatatatatagttaataccaaaatatattttggaagaaacaaatactataaaatctgatttagcaatataaaagtaatattaattttaatgatttgcctgattcttattcattcatagacatttgatgagcatctactaagtaaagctgcaggaaatataagtataaattagaaactctttccaccttaaaaatatgcttgtgggtttactggagaagacaggtatttaaacatcagcagcttttttctaccagtggcaagatttatgttgactcctgaacagtctctcttgaggtcttccttgctaccagagacacatgcacacacacatctgtatgaggattagccaggtggggctgttaactcatcactggatcacagcacaactatccttcccccaaggttataactgtacccacaaccttataacttgcctatttttctgtgatgctttaatcatgcacagatgtatgattaggctataggcaaaactcatgcaaaacgtaataaaaggaaaaggagaatgaaactaaaacagaagtccctatcattattacagaacaaaaaaagagagagaaaatggactaaccgcttagactagattttggaaaataattgacagttatgaaaaagaataagaacaaatgcttacatagtgttaaccttgagccagacactgcaggtgctttatatattttgcctttttatcctcaagaactctataagataaatactattattatcttctttttactgatgaagaaactgagacacagaaaggataagcatggtgcccaacattacaaattgggtaagttcttgggcctgggttcaaattcagatgattgcgtcagaatcaacactctggaccaccaccaggacatctgtgatacaaagttgagtaagtactgaccaagtcacccctctttgctggcaactgcacctaatgttatacatatgtatgagaacatgtggtatttgcttttctgttcctgcattagtttgcttagaataatagcctccagctccatccatattgctccaaaggacaggatctcattttttcatggctgtatagtattccatattcacaaccaatctataaggtaaatcttatccccacttgttaataaaggaaaactaagaacagataactattattgactgggtttggatgaaaacacaaggctatttgaattcaacacagtgtgcttttagggggaaattgtctttggacttcagttctgtgaaagtacaagtcatatcttatttagtttagattctaaaaccatagcatgtttttattaatttttaattattaaggatacataatgggtgtatatatttatttgatattttgatacaggcatataatgtgtaatgattcaatcagggtaattggggcatctgttacctcaagcatttatcatttatttttgttaccaacattctaactccactcttttagttgttttaaaatatagaataaattattgtcgagtatagtcatcctcttgtgctatcaaacactagattttatttattccatctaaccatgtatttgtactcattaactatcccatagcatagagccccaaagcaaggattttttttctactgcaaattgcatcaatttgaattaaaagtgaactaatctaagtcccttttttattcaagaaaataaatctagtaatgaaagaggaaaattatatggatcatccctaaggacaagttttataaagtactttaaaaaaatgtatgagatgtacttaggattcctgcctagtaagccatttaatggaatctttgcactggtcttaaatgcgtctgtgtactgcttgaaacctctatcactcctttccttttaaatctgttcctcatattaaataattcttacctaggttttcacatgaatggtgcctaggcagatgcaagaagctgctgctagggaaataaaatggaaactcagaaatgaaggaagctgagaattgccaagcagccacagactcccactctatacccgcttcctcaccccaccctttcccacatgtcacatacacattccaattttcccttgcagaggaaatgaagcaaaacacatcaatggagtgaaatggtttgtccctaagaatcagaaaactaaagcttctcttagcaggtacaaaaaaaaatagcttttcttttagttaagtaagactcctaggcaaaacatcaaaatcctgggctcttgataacttttttgacatagaaatatttatagagatggctctttatcaatgattccagaaactgtttgacttgaagttgaaaaatgacttcaaggtataaaaatctggcattagcaccaagatgttgaccctgaattctcttatttttaaagattaaaaacaaactcataactcctcaatgttaaatatgttttctggacccaaaaatgtttttcattttacgttgataaattactatgttccaaagcggactgcttttctcctcctgggaaaaaaaaataatgtatgtttcatattgatattcttctctttttaaaattaacctccaaaaaaagctacataaacacatgccaaaaagtgacatgttcaaagaagaaatgaaaaatgtcactgtgtgtatataccaacctcccgtgtgtatacttttttaatgagatcattattttgcatactgttttgaaacttgttcttttaatttaagaaatatgttctgagtatcttttcaacacagttgtatttgccattctcatgggacttgtggtgaatagatgggagaatttatcaacatgcaaatgaaacaaggctcttgcccgagctgagtgaacttgggccaaggaagatgacactgattaggtgagagaggaaaccaagcttagaaggggcagaagtctgggacctaaaagaggcagccaggaaaccacattggttatgacagagccttttcaaggtcaggaagggaagttcatgacctggcaagcaacaactaggtagatgtaagagcacattaccgtgcccttatgaggagccagaactagtcattgtaagctaagcacttcatgtctattaaatatgtattctttacagacaatagtccatgagctggatccagctgaggattttatagaagaagtagaggctcagaaaagttaaataatttgcctgagatcacacagcttgttagagcagggattgtagtcagggtgttttcctcccaaaggcacagcatgttccatttcaacccacagacaagctttattctttatccagtgccctttttcacaatgtccctccttctgcctctgtacttgtacacatggttaaatataaattcatctcccagaaaatcttcaacaggtcttggtgcaaaagactcagggttcttcaatgagctcaatgcatgttaactggtaaatctcatggcttatgttcatggagtatgtgtatgtgtgtggagtgtgctagagtgtgcacccatgagtctagcatatgtttatacaaacatttgtgtacaaataggtatgtgtagatgcacatacaaaattataaacctcactgatcttaataaccattttctacatattttcaaaggcagggaattaggtctatgacaactaggtatcaaactttccaaaagctaataagagatgatttacggctaacacagacacaagagaagtacaaatgcaccaccattaaaaatatctgatgatggccaggtgcggtggctcacgcctgtaatcccagcactttgggaggccgaggcgggtggatcatgaggtcaggagatcgagaccatcctggataacatggtgaaaccctgtctctattaaaatacaaaaaaaaaaaattagccaggcatggtggtgggcgcctgtagtcccagctactcgggaggctgaggcaggagaatggcgtgaagccgggaggtggaggttgcagtgagtcaagatcgcgccgctgcactccagcctgggcgacagagttagactccgcctcaaaaaaaaaaaaaaaaagaaagaaagaaagaaagaaagaaagaaagaaagaaagaaagaaagaaagaaagaaagaaagaaagaaaaaaaaagaaaaaagtctgatgaataaatcttcatcactgaaattcagaatacaagtagaaaattccgtctatgtattggagtttgactatatttgtgaaggcacagtatataaacacctttcaggaattcatctgttgctttaagagaagtctgagagttttttcttaagcattttcaacataataaataaactactatttgaacacattttgctgggtcttctccctgagatattttacaaattatttggatcgatagtacaaaattgcagtcaaaccactaggaaatgggattttaagtcagtgccttagcctcatcacacatctggaggacaccattcccatacccttcctaccttgttcaattttaagtcttccatggtggtacctccatcgtctgagctacaatatttgtttttgcaaatttggagggttgtactaacagatactctctacatttcttgcttttttccctattctctcatttgccaccgagtctttcccttctctttgaacacgtctgtaagaatgatcttgcagtaatatacccaagaaaatgcctcctttatctaagtcaggaagagtgttcttttaaaactatgactgcgaatctcaaatgggcactcagcactgcccggcaatcttctcacatttgctcggtaaattcacttccccaggctctgataagactatatggtatttcctttctccttgaaatatcaattactccccaccacacaaatgcttttcacctcaccctacttcatactaactaagaagaaagcagttggacacaatatctctcaacttcccattatggatacaccaatatctaagcctatattctctgctttccctagcatataatgcagagacagagaggctttgctgcaactaaagccaactcctttacaatatcagggacctcagtggttttttccctatagcatccccagcacctagaagagtacccagcaggagctcagtaattataaattcaatgaatgaatgaatggatgaatgaatgaatatctatgactatgaaagattctatctgtcctaaacggggaggaggacaagcatcaggacaaacagttttagggtgatactcgacatctgtaggacatggatagataaccatatgtaaaacaaatgataataaataggagataatattcacccttgcctcatctactctgtctgtcttatctggcttcttacattgtatctaataattaatggttacattcataggatatattaatagagccagctaccttccattcatctctataagtcttaacaacagtgaccaatttacataagatgaaactgaagctcaaaggagtcaagtatgttacccaatgtcaactcttaaatgaaggaggtagggttcaagtctatggatttttttaaatggtaaagtccatactctctccactcagccacgctgtcaatcagcccctgagaccttcctgtaagtccgagttcaactgagtttcttagccaatccttcgggaaataggactacattctactgcagtctactggaaatgtcatgctgtcaaataatcccatcctaattgtgtcaggcatgaagtctaaatggccacagagataggcagagagacagggggacccctaatgggaactttatatctaccctctgtcttataggattggatcttgctttctgtgttcccagtcatgaattttaatcatgtaagaaaagacaagatcttttaagattacaacaggagcagatcttggtattgtgggatctgaaacacatatgatttggggaagtggggtctatgagaaaagaattaaaaaatcatatgtaaaattgggcatggaagttaacatttatttagactaggaatgggaaggggtccatgcatttgaaagtctctgtagcttaatcttcatttacttcaaacctaattctgcctctgatcatgatctagccctatctgggaggcaggaacacggtggttgagagcctttgttctccaggtgggcagcctgattttgaatcccgccttgaccacttctagttatatgatcttaggtgagtggctgaaatttcacaagcatatactttgtcatttgttaaattttcaaatacaactggatcataaaaactgttaatatgaatgatcatataaattcttgatcatagtgcctgacatatgctcaacaaagtgctcattaaggtgtgtttgatattattagcatctaatgccatcttcttgcttaccagctctggaacctctctatttgagactcccctactatattcatttgatacctcctgaatgcctgagcaccaggcacttaggatttgactctgtgtcttcccattatgtaccttcaacaacaagatctgggccctaactccctgctgaaccaaagcctggttcccagcctcactacaactgtgtcatcgcattttggcatacctattagttttataagaatccttgtttctgcctgtgtaccagtaaaccttccccattttcctgggcataatccaataaaactagaaaaaagtaatatcatgaaaagcattcacaatagatttttaagtgaagagctagaattcctataattgtggctaataaggttgtttttacagggatatgcaaaaatttaatactacaaatatgtaaaatggtgaggtcctcacctagaatataatgatcactctattatagataatgtaattattacaatatgtatgctaccaaatagcattgtgatttctaacaagtcaattaaccttcctgggcctcaatttactcataaaatgaggaagctggactacactttctatgattcttgctagttccaataaatatgtattagtacatatacctgggatattaatgtatcattcacatctcaacttggaatgtgcccaatttgaatatttccctttgaagctgataagtgagggagaaggaactactcaaaggataacaacattgtcttctttttttgtgtgtgaaattcacctttttacctctactgtcacaatattctcactatggcaagtgttcaaggaatattatttgacttttcgaaattccttctctagtaaagtcctattaagacaattaacattgctcctaaaagtgtaattataagtgtggtatatatcccagcttgttgaagcaacctggtaagaagaaatgaagactagacctgctcaccccatgtggaaggtagagggaaaacctagatcaatgaagagcagtgaagttttggcttgcgctcacacgaaagattgggccacaggcagttgtttcatataaaggaagtctgaaaataagtgttgaatccatgccctggtggtatctggtgcagagcaaagaggtgtcttggagtaggcagctatggtacagaaacaatatcagggcgtataaaagaaggtagaatcaggaactgtgtagagactttctatttgaacccttcaatggctttccagtaacaaacagtaagttctaaagtccttataatggccctgtaggatatgaccttggctctccctccattgctcctcccattaccctggcaagctcactctgcttcagctacactagcctgcctgtgctccttggatatatgaagcacacttctaaccagagtctcttgtatgtggcggttcctttgcctggaatgctcttatcccagactctctcatgtctcatgcactcatttaagtattttcaaacaagtcagttctttggaaaggctttctctgacaaccctttgataaataacaccctgtttctgtccccatgctatattttgtgcttgtctctattaaatattggattatatattcctatatattcctttatttatatttttgtcttgcttccccaatagtatatacatttctcaaactctgcaactgtgttcatatactgtgcttaggacaacatatggaccacaatagaggcacatgcagttagtgaatgaatgaatgaatgaatgaatgaatgaaatccactacaactactttgattcttatttttgtagcatttacggtttgtatctcaaaactcagcagatgaacttgcaagaatggaggctttatctgttctgcttatggctgaatccccactgtctagaacagtagctggcacttgggagttctcaatagataatcttaaatgttgtttaccatgaaaaagttcttgtactctagttttaagaacggaaatgaattgttctttgattttggtaacaagtcaccatcagaaccagttttaaactcaacccaatcaatcaatgacaattttgcattagtaaccatgctttggaaagcctaaaactctatatagcaacagcagtgtttggttttgagtgacagcatcttacaagcacagctctcacttgtttaccaagcaatgaagcaacttttggtttaaggcattgagctgtggtctctctctctctctctttttttttttgatggaaagatgatggttcttagctataatggcaaaagacaaataacttattataatcttatacagggttctaagcatatagaaataccaactatattaatccacaaaacaagcaggagagggaggtgctatgattattccaatttagtagacaaagaaactgaagtactgagggttggagtgcttatccaatgtctacagccaaggtgtattccagctgggattattattaaatccaattattttggcttcagagtctgtgttcttagtttctacattctatggcttccctatgagaactgaaacacacacttgttataattccaggagccagatttgtcttgatgattagtctactgacttaatcaaatgcttttcaaataattgtcataaacagtctggccggtgggggtgaatttcaaacagagaggtaagggcagacatctgtgggatggtggcaccaaagcaagcagttaggaaggtacagaatttagaatttaataatcggcatgttgaacaattaaggtaactgccctcgtgacttgtgtgtgtgtatatatttatatatgtatgtgtgtgtgtatacatacacacatacataagtacgtatgtgtgtgtgcgtgtgtttgtgtgtgtataaatatatgaatttctggtaagtcaagtgctatatcaaatatgtgtatatatatatatatatatatttggaaaggagatgaataattgttatttgaatgtggtaacaaatacccaccagaccagttttaaacccaacccaatcaatcagtgacatatatatttgttataggaccttggccttccaaaaattcatctgtggggtatctgaactggctaccagatggtaatggctcagtattactaaacgtattcagacaagtcatagaggtgaaaaacacctcaatttatggctaagtccctcagcctgatagttctttgtaatggcacctatttctaaccttaaagttatgccaaaaagcaacttcactatcactcggccctaaattcttggaccataagcagaataacaagagagctacaatttgaataagcattttatgaaacaggttatgtttgaagtttatcttctgaatataattcattagctttttctttgcagaaaagagttctgtcaataaccaatcatttttagttcatttcgtctctctgggactcagtttccttatctataagatgatcaatttgaaactggcagtttctgcaggatgttttgttctatgaaaccttgaaaaatcagagctacaattatgtaaattactgatatatcttctcttatttttccctcttcctcatttttctgggttcactatagtacctatgcttttactaatgtctctacatagagctagaagcaaaaaaaaaatgaatcagattcttaaatacaatttttttaatgggcatattctgtaagagaagttcatactgtgtatgacttttatgtatctctgtatgttttatcttacttgggaatatttatcttgtgcagtcacaatgaatgccttttggattggcgctacaataaagatattggaattaatctagactccttcatttacttccttgtgatcttaagcaagttattattctccctgaacttctagtttattcatctgcaaaatcaaaatatcactttcagtcttgcatgattgagatgataattccaaggcgaggcatatgcaacactttttttcatcctctttgtcttatacaggttctcaactaaggtaagctttcttccctcccttgtactctgttctcaataactagaaccatcagtgctccttcttgttttttacttgctgagaaaggttggggtgtgtgttttctgttgatgaccatcttcatcaagccttaaaacccaattgatgcttgtgttatgctttaattcaatgctggatgcacttacttcaaaatattactccaatatggatcatcttactgccttcatccatgcttcagtcaacccaatccatacatctcagaccttttcataaataacagtcgtcctggattcaaggtctcactttttctcagtagcatcttatgttgaatttcctcctttctccaatcaccagcccttctctgccccatctatttccagccatcccatttgtctcccaaagcaaaacagatcgactctcagtttgagaataaacatttctgtctattttcttttcaaattttaccccagatcccaactaaagtgtgcgcttgatttgactgaaatttaatgctgatttattcatgttacaagagtttgtttaatttataacatggtgcctttataatattattttactgtgtttagaagattacagtacacatgcttatgcttgttaaataatgtaagtgattgagagtatttcatgcatagaatgcgtccaagaaaggcttgtggaaaaccattaatggatgcctaatttaacactttctcccctttgcaaaattattagccattgcccttgatgttgtaatgcttaggaaatgaaaattatgtaataagatacggagtctgatggcctgagtttgaattccagttttatgacttactagctgagttaaccttgatccaaattcagtggactctataggtctaagttttcttatatctaaagcgtaagtgattacctatctcaaaggatttggtgaagattaaataagatatagccatactatactatattacatgaataatatatctatactatactctgtttaacacatgtctgacatataggtgataataaaaagatattaatattatttataattgttttattttatagctaaaaattaggattatgtcagtcaaataatagtctaaaatcacatgactaataataagtgaagctgtgattagaatccaagttaaataactttagatcctctgagtgtaatctctgaatatactaaatctttttcttccaatagttcccttttaggcattaatgttcttgaaataagaaaagatgaaccataagagaccctaaaggcggtatatgtattccctttatttcattactagatggtgtaaaaagattgtatgtttaagttttctaatataaagtatttttctctttcttaaactttacagtttacaaagacttctctgataccccaaaacacataagcgttggcatgccattgcactggaggaaccagaatgctgggagaattagaacaagactctgtgaatttcaactaagctatttgagatggaaatcagcccctcctagtcatctctggccccttggtccttattaagcaacatggtctgaacacgccatcagtgatgtttttgaatttgcccaacttactgacagatccagcacttccccacttctgtcaacagcacagcagaattaagaacttgggttctaaaaatccatctttgtgtatacagctaatattttgattaagcctcttgggggaagcttgtattacagtattacagatatttgctaaataaggtgagttgaataaatacaaaagacagcctagtccttaccctaagaaggacttagattaccagttgatttctttttgtctttttatcaaagataattaccaataacagtgacttttttcaagtcatgtgtgataatgcatttttgtgaaattttgcttttattaagggtggtagaaggatggttctttcttaattcagtaactgcttcagcataatttaatacatatttagatgaaaagtagatattttcacagcccagtgttacatatagagataatgaaattgctttgccattaaaattttgattcaatttctccctggaatgcattaacagaaaaccactttcatttttatagttgaaagaaaaaggcaatttactgttgtgaagtttcaggagtattccaaaccagcataattctggagcctcctaaactccccactaagtagagagagtctatgaatttaaaacactggccacaggtattgtgttttatccttagaaatctgcttctcattattattttcatgcctactgcactggcattaagattacttttcttcaaaagaaaatgtaataaatattaatggaattaccaaaaaagttaataaatgagttaataaataataatatgatgtgcttacttgttattgaaactcttaagtttcgagaaacggtatcatgaggatgcctgaaacagcagccccacacgtcaaattctagagctacaggaaaggatgtttctctattctcttgaaatacaatgaatatttccctgaggtatgatgaattatcctactatggaagagaaggaaagattagtctaaccattatactgtatatcaattccaaaataggccgctgatatctattttatggtaaatgatatgtgttacataaattctcaaattttaatttcctgttacactcattgaagttttgaaattgaaagttccatggagattatcaagcccagttttctcattttagaaaactagagaggtaaagtgacttaatccaaggttagagaaagcaagagagtagcagaggaggcataagcatttgtgctccaactactattttatattctcaggagaaagaatgttacctgctaactgtaactcttgggttataaacatatgacatggatctctgtgtagtattatgtattcatgaatatcacacatagatcagaacaggacccaagactcaaggacctaatccccagtcttctacaatgaaggagaactcaaatcacttaaagataagcaaatacaaataatttaaacttttatattaccaatttattttgaagtacatgtattctacacatagataaaagcaaaataacaactacattatacaaatgtcatattttatatgtccttcagaacaatatgcatatttcaaatataataatacaaaaaaactacattgtgaataccatgtatactataaaacagttgtaagtttacatgaggaggtttaatgatttagggaaaaagttcacaatcatcctcataaggctttaacctaggttcaagattttctacttaatattcaaattctttcataggacaattgagcagacagaaataagaaaggtgaaataaatcattatcttctgaacttagacatgcaaaatggtgcaggaggaaaggaactctcaggcgaaaagaaatcggaatgaaatgagcatcagtacttttttttaagaaagtttcagaagaaaactatgaagatgctagcttgataataaacattgcttatccttctattaattaaaattaggctgtaactgtagagtgcacacattctgatctatagacttaaactacacacaatcagctatatcaatctattcatttgttttttatctccagctagcaaagtatttagtcaaattaaatcttgttttaaagggcttctcactctaagatttactttggagatttgtcttatacagacttccaaatgaaaaacactattgctttctatctctgtcaacttttattcattaaatatttcttccttaatgtggttatcaacattttactatttataattacttcctaacaatcactggaaatcatatatgaagtttatattaaagtttctgagatagtgcattctctccatagtattagtccaagattgtcctggagaatgctgatattgtaaaacgtaaagtacaagagagaaattgttcatacaaatcagtacagctttgaattcaagcaataataaaaaggaaagacttcatagaggttagcagctcttagaggaaggaaacacaagttctcatttgggagagggaatatttgtgctcctgaaacaagcagaaccaatactagagtaggtgtcatcaccaaatccagattcaaagccttccacacaagagctgaaagaatggccacacaacatccatgaaatgagatgaaacaagtccctcaacagagctaggaattctgagattgttccatgaattgtcagtctcacagagaataaaaaccagttcattaaaatgggacatcccaatcacatttgccaactaaaataacacacacaaatgaacagagaagccaaaccaagttactggtttcatgagagtgtacaacatgaagtcagttttaaagagcaatggccacttctagattttagaacttatcctctttctagaactacagatatttccatcagagagggctaccaaaagcattctgcaacttattttaaaattaaataaacaaacccagctctccaccatcccccgcctcctgcgccctgcatcccccgccccatgagttataaatgtaggtttctggtaacctacatcagagtgacacacttattttaatttgatgtttgctatttgtaaatgcaatctcatttatgttacactgtggcagccattctctggagggctggattagttgtggatgtaaatacatttataatgtattttcctttttacttaagtttaaaatttgaagcaaggaaaatatctaaacataactacgtcaaacatcatctagagcttcttttaaaaattgctctgccaactttagagaaacaatgactggctgtatgcaaacacactctcaaaatgtgttctgagcagttagaaaattataatgtaaatttactcagattcccagagaaacatttaatttaggaaacaataaggacaaatacaaaatgtattgtttaaacaaagaggtgattgataaggagaacaggagaacaagcctctaatgaacataaacagcaatacttgaaaaacaattggctacctggaatctatgttaaagtctgttatatgagttagagtcttttccccttagaatctctgttagcatgtaaaataggtaacattataaacacttctccagaagactttatgaaaagcctgtcattctcaggctccaaccttagaccataagaaattatgtctatttatttccatttgatcaatgtatttgcatagcaagaaatgagtgatctcacaatatacccaaataaaatttgccgatacaataaaaggaggtactagataaaataatcaagcatcagtatggactaaatactctcaaaataagcaggtagatccattacaaacccttaattacttcagtttttgttctgacatttttgatccaaagtgtttctcctagttttaacattctcttgtgaaaacattactgcaacttacaaaaagtttatttcattaatctttcctaccctgaaaaacctggcttccttcatgtccatcccagagtaacatttctctgatctcatttcaggtgcctcttacattcacctaagacattttcattgcaaaacagagaatttttagaagtcactaaaaagcactcccttaccttctaaacctgcttcaatcagcccaaactgttccaataatttaacaaaaagcacaatgacgatcagaactgctatcatttcaagcccttccaagttcatggtcagctaggtcatggtccgaccacagccactgagaagtgctcctctgcctggctttctttgtaaagccattaaactacattaagaaggctactgctggagaaaggggaggaggagagcgtatgagagagagagagagagagagagagagagagagagagacagagagagagagagagacagagagagagagagagagagacagaggagagagagggagagagagagagaagggaaaagagactagatggagatggagaggctgagaaaaagggcgtgagtgacagaaaatgcattcatcctgtctgctgtagcagaggccagaagtagcagccggataaagtcgggcctgtcggaattatcggcttcctcattatcactcttgcacagagagacagccacgcatgaagtcgcggcgcagatcacccgaggacccaggaggtcaccaggaacgtcccgaggaaacatgaggcccggcgcggaggagatggctctgcgccccgggactctgcgcgccgcgccgccgccaccagtggctttgttgggccggccagttgccttggaaacaagagaacccaaggaagggctggactcctgctgcagacagggagcagagcaccgcaccttgaaatacggagaaaaacctgaaaacgctgagaggtggagtgacaacttgcattcagctgtttcagaaacattgttgaccagtaaggaaaatccaaatgtgtattttgtcccaactagctgagtgcagattgcaacgaggcttaagggagtccttcaatattgactttctttcccatgagtcaccttatccgaaagctcagtcactgagcactaatattctggtttgagtagtaactatcatatctttttgaagcatgggaataataaactaataagtattcatcatatttgcatagtatcttagagtttagcagctacctcctctgcactacttcataccattcaatacaccaaaatatatacagtatttaatgtgtccttctatcctttataaataatgatgtaagtaaatttggagccaggaaaagtttgagaataaaaaaaaaaaatctgaaaaaaagcggaagtttttgtctctctcttgcacaaactgtttcatctttttctttcctcctaacactgcccaaatagattagctccacaatgaaatacagaatttaaaaaaactacaagagagagacagcatcttagaaagccaattaaagtctcctatttcatagatgaacaagctgaggactgaagagagcaaaagaaatgaggcaaaaaggcagagcaggatagaatgaaggcatccttcacttggggttggcttttgaggcagtggagtataagtttagaatataaactccagggacagactgctgggatctcttactagctgtgtgaccttaggtaagttacttaacatctcagtgtcttaatgtcctcatctatgaagagaggcataatagcacctagctcatcactctgttgagggaattaatgagtgacacttttagaaaagagtgagtgctcaatcactaccacctcgggtgcttttcacaagtgtctccatgctctactcagactttgctgggttgccagaggaatcaatctggaggaagtgcagtcctcctcttatcattctcttaatcagaaaccttccatggctccctatttgcctacagaacaaagttgaagctcctttgaagagcatccttttctctccgtgatccggtacctccttgaggattgcacctcagtggtcttactcctgtcgatacactctacctgacagctcagcttccttcacccaaactcattctgggcttttccatttctaggactttgctaaaattgctctatctatttagaaaaaccttcttacaccatctctgcctgtcaagctcttaaaactctttcatggaaacttcaaccagaattggatcaaatctctcttttttgtgtttttacggtacttttcctacttatgatgtattatatgatagccatatgggtatacattctctccattaaagggtaggctgccagagggcagagatcatgccttgctaatctagatagtcactactgtgcctccatggagggcacttcttacttcatagatgtttgctggataataaaagtcatcaatgattaggtgattactacacaccagatgctttaatgcattgctccttcctagacattctaaaagtagggatgatgatttgcaggtgtaacactagcctcagagaacctaagtagcaggctcaaggtcacacagctggtgaatgacggaaccaagcttcaaattctgatgtgtttaatgcaaaacccattacttcatcccattatccaacagggctttaaatgaattaaaaatccaaatattggcacaagtgcttatcagcatggggtgaaggttatacccaaaatgatcccccacactgttttgtgacattcttttttttgagagagagagacagggttttgctctgtagcccaggcttgagagcagtggtgtgatcacagctcactacagccttaacctccagagctcaagtgatcttcctgtctcagcctcccaaagtgctgggattacatgcatgggctaccgcaactggctgacacactgttttagccattaactccggtaactttggaacatgaaaagcatccaaactagtagttaattaaactcaaggatctttcttcctcctcattcacaggattaatattacttaaacacacaccacctcggaactcaaaagggagttgtttttctagtacagtgaactctgcagagcccttcagcttgccttatatatgaatgtccatagtcaagtgctttgtgttcacatttaaagttgatgacctggggctgagaaacatatgtaggcaggaactttttttttttttcttgagatggtgtttcactcttgttgcccacattggagtgcaatggtgagcgatctcggctcaccgcaacctccgtctcctgggttcaagcaattctcctgcctcagcctcctgagtagctgggattacaggcatgcaccaccacacccagctaattttgtatttttagtagagacggggtttctccatgttggtgaggctggttttgaactcccgacatcaggtgatatgcccaccttggacccccaaagtcctgggattacaggcgtgagcaactgtgcctggcaaccgtgccgggccggcaggaactattgaagagcatcagagtgagagtccttccacttggtctggatgtcaaaattacgggttcctttgctgttatgtttttcatcccaaggcctgagggtttttctttttttaaatgtttatgtcattagctccagcctttgtatttccctctcttgcagtgcttatccccatatcttcccatgagtaagtgacttgacttaggtcttagttccaaaattcctatcacagagaggccctttctaactgtactatatagaaaaacctccctcacctggccctggaatcactaccctctgaaccagtgttattttcctccaaagcattgtcaccacctggcatgtatatttgtttattaagtgtctccttctgccagaattgctacaatataaactcctacccatgagggtagagatttttgtttgtcttgttcaatataatatcctcaatcccagaatggtgcctggtgaataagagggagtgagtggttgttgaatgaataatctgattgatattctcacctaaaaagctacctgctctctcactgatctggcagagcccaatttcctgttaccagcatgcctcctctgcctggggagcctgagagatttccatactttttttttaggaagtcctattcctactgcttctttttaaggtgagccatgagcactgcatgctcacacatattagctgtgctctatcttcagcatttaatgtgaatatgatttgtggttcctgcccacgtgaacaatgaaagcaatacaaggaaggcagccaagaaggttgccctgcccaaaatatcttaaaatcactggtgtggatgataagtaccttggatagcatccactctcatcccttcattttcagctaaaagaacactgcagtctaaataagtaaagttacttaactacatatgcaactcttaccttcaagtcgcagcgtggattcaaactaaaatattaatccaatatattttcttcctgtagggccttgaattcccttttaaaagagaaatattaagagcatccaacagaaagaggaaacctaaatactggctccaaatctttgtcctcgtttggattacttaaacttgctaagctttggtttgctggtcttcaaaatgaggccaatatccctccttcagggaagtgttgtgaggattaggtgcaataatatttctaaatgatacttaatctccgtggagcacatacgttttcaagcagtgggcctaacacatagaatcttcctttctaaatacccctctttgaggaagagaggggtttacatttccatcttatggatgaggaaacaaaggcttgtgaaggactagtcaatttcccccacatcccaaagcatctgaagccagtggggctgatagctgcttgctgatggtcataacattttcccatgtgtctcatgtaacagtggccaggaatacccaaagcattcaatgaaacaaacatcaccagcataagtaacccaacacttgatagtgactttttaaaagatttctcgccctttctgcattaatgttagatacaagaaagttctgtgcccctgccgtgtgagtgtgtgtgtgtgtgtgtgtgtgtgtgtagcagataagtatgaagcggcagtgagagaaaagggacactgttgtgacagtttgccaaaattttcttctctgcaatgcattctcacgtaactactgaggagggtgagaggctgtttcaggcgcccccatttaaagaagtttcttcaaagcaattttggggagtccttcagctcaggctctactgctgcatgaaggttatctcttgcctgtccccagaaaaatgaacgtgcttagagacactcttacttttgcacttcagagcgtacccctaaagtgcagtttattcaaaatcaccagttaactcacagtaatgaacccatttctgctttgattccagcaatatggcttttggaagaaaaataatgtttataaaatgaaagattagtttgccctttgatgaactgaggcagggaacaaagggattttggcacgttatgtctctctagattccaggctgggaaggctttaaagagaagaagagaaagggggcgaactttctctacgctttcaccacagagtcccagtgagttggccttctcaagacctaaccttcattcagtttgtttctgattgttcatctttcattcaattgctaaagttgtggtccaggtactatataagccagtatgagtaataaaaagatgaatacccatttttccatgagctgattattaagtatttcatacctgtacaaaaatatcacttgtagcccataaatatatctatgtactcacaaaattaaaaattaaaaaaatatatccttagtcttcactagcttaaaatctattaaaaacaaaattcagatgataatagctcatgtgtgtagaataatcactatctgagagactagcacacggagcactttatatggattatttcactgtatcctctgtaaaccctatgaggcagctactaatgctatctccattttgcaaggggaaattgaggaatggaggcctcattgggttataccaggaaatatccagctcgggattgaaacccaagtctgactccagtgatcaagagataatattttagatgccattgaaaacacctgaaattcaaagcagcatctggtaaaagtctttaagaaagtatggaaagtaccatgagatcagggaaagctgacaggctctaatggtagtggcaggtaggggaatcgaactaagatcagctttatagagatcacgttgtgctgatactatgtagatactaggtggtatttttcttttcataggaaaggcaatgtatattacatgaccaatggagaagaaaactagtcttgccagatattttttggtttttttgagacaaggccttgctttttcacctaggatggaatgcagtggcccgatctcagctcattgcaacttccaccgcctcccaggttcaagcagttctcctgtctcagcctcccgagtagctgggagtgcaggcgtgcatcaccacaaccagctaatttttgtatttttagtagagatggagtttcaccatttctagggctaggctggtcttgaactcctgacctcatgtgatccgtccgcctctgcctcccaaagtgctgggactacaggtgtaagccaccacacccagccttgccagagaatttacccagagcctgaaagaacagtcaaagcccatctcaaatcacttgcccaggtgctcctggaaagtttcttcccctcatttttcagaccatctcctattctggtgcgcaaaatcagcatcagtgacctgcctttaacttcctttggcacttacttgatccaagagaagcctggctgaatcttaggattgagtgaatagaaagcaaatttgacccttcaaaatgaactgaaagaaaacgagcagaaggcaaaggcatcacataataaatgtatttctttcttcttcttttttttctttttttgagacggaatctcactctgttgcccaggctggagtgcagtggcgcgatttcgggtcattgcaagctccgcctccgaggttcaagccattctcctgcctcagcctcccgagtagctgggactacaggcacgtgcacgacgtcggctaattttttgtattttaatagagacggggtttcaccatgttagccaggacggtctggatcgcctaacctcgtgatccgcccgcctcgacctcccaaagtgctgggattacaggagtgagccactatgcctggtctgagaaatgcatttcaataataatgtgaaaagacaatgagccgcatttatggcagaggcagtacaatgcagaggttaagagtatgcttgggtttaaatccccactttgtttctttagagccttgtgactttgggcaaattgctgagataagtcatacaaagcacttagaacagagactgtcactgtgtaaatgctcaataaatagtagctgttattgttatttattgagctcttgctacacatcaagtactgttctaattgaattatcttaatatgtccatataacaaactcaatgaaccaagtactattattattcctagccactatatggataagaaggactagggcatctgcaattgaggtggaattctaaggaaaacacattgcttatacccacccatgaagctgaccaccatcttcaccacgagtaatataggaagaaattataaacttataatggcttggtttttaaattgttcttcttaaaaatgatggaaaccacctgttatcccagcactttgggaggcctaggtgggcggatcatgaggtcaagagatcgagaccatcctggccaacatggtgaaaccccatctctactaaaaatacaaaaattaactgggtgtgatggtgcgtgcctgtagtcccagctacttgggaggctgaggcgggagaatcgcttgaacccaggagatggaggttgcagtgagccgagatcatgccactgcactccagtctggtgtcagggcaagactctgtctcaaaaaaaagaaaaaaaatgtaaaaagcctgaaaataactatcttgaacactgatatttgaggacatctttgtcaccttccattctgaaacatttcacaagatgaacagatgcagtgaggtgttggcatgacatcagattacagattctactcaaattcaagtggggtttcaaagggtcctatcatcatttccttgaggaaacccaccttcaagggcatatttgactgcttcataagtctcatcagccccatgatctatgaatcacaatgtagttctagactagtctagtcttatttggtctagttccatgactagacaatatccttaatgatgaaggatcaacaccacacccagacttcaccacccatccttgtcctaagaataaatagcaaacacaagctgctcagtgggtaaaggtagttaaatggaggaacaatagacagggactcaaacaactcatttgagctgtacattaccacattcttaaaggactgaagacaaatgggaggaaaggaattggtagcaagagtgtccagcactggcaagagagaacagagaactaagctgttatacatatgtattgactcgtggtgctcaaactgttatgtgcatcagcattaactagaaagctccctaaaaaggaatcctcagacctttcccagagattctcatttcataggtcttaggtagagaccctggatctccatttttctcaaaagttctaatgattcttatgcaggacttctctggaccacactgtgagaaacactgcattaatctgctcaaacaccctcacccatgtaaggaacacattctcccagctcttcaaaactagctgagagtcacaccttttacaaacttgacatggttaagaatagacgggggttccttcggtttctcatacttctctggaaagttttttcttcgaataaaagtaaggcattttaaacagattgggaatagacacaagtttctattccatatttaaagggttttgtttgtttgtttttattcaggtcattcatttcctgcattcatgacaactttctctcatcaatgagctttagataccaactttagtagagacagaggactgtgaatgatcccacacttttctgcatcacttcataacctagctcccatctttgatctgtccctggagaatccgtctttcagctccaaatgtaatcacttaagtgaagggcagaactgatgtgcagccatcttaatagccaagctaagtgaagtaaatagaattgatagatacaaatgttcagaagtgtgaagctgatttagataaagtagatatttcagtttgagatctaataaaaagcaaaacagcagccacatggagccctttcccattactccctgggtctaatctttatctaaatcaatactataaaagtaacaaaagacacaaagttgtctgatgcataattcacttattatgaactcatgtaagatgcaaataattgaaacaggattatttatgtgatcattaaacccaagggtaatttcaacagatttttagccctggttaataaaaatcttagttgtggatacatatttagccagatttccttccaaatatcgtctcctccaacaaattattcctcattacagctgacatgctgtacttcctcactgtaatagagtataaataattgtttatcctattattttattgcaccaaagaaatataaaatgtaaaaagcaatatacaacaatctccttgacaattattcatgtttatatgctgtagtttaattactaacaattctaactactcacttgttattaactttgattttaaacacaaatatttcaaataaaaaacctatgataaccaagttaaactagaatcgaattatgaatactaattaagtatatattttatttgaaaaacacacaggacaccgttagtagaaccacactgaaaagaaaaattatcctcaatgcaatggaaatgtaacccattaaataatacaaagtggcctcaaagaattaaagattagcttgtatggataactgagagcatgctatgttaagtttattatgagcagactaaaactctcttgaagggtcatcaaaacaagccagtcaagcctgacctgctggtttgataactcaggatggcacctctctgaactacggtattgtttcacagttttctactgctgcatagcacatcatcccaaattgagtgacttagaacaacacaaatttattatttcacagtttctgtggataaggagtctgggtacaggttagcagagtgctctattcaggcttaaatcaagatgtaggctcgggctgtgatcatatctgaagctctgtgtcctaagatcacagtttgttgaaaggattcacttccttgtagttttatgactgagttcccctgctttcttgctagctgttggacagggaccactctcatctcctagacattgctcttggtgccgtgttctgtctgcaatgtggtaggttgctctttcaatgctagcaagaaatgtcttccatgcttcaaatttctctgacctcttttcagggcttggccgattaggtcaggctcacttgggattgcatccctttggattaactcaaagtcaactgattaggaaccttagttacagctacaaaatcttttcacccatatagggtaccaaaattatggtagcaatatcctatcatagtaacaaatccaattcacacttgaaggaaagggattatatagggtgtgtacatcagggtcattttaggtgtgcaatcgtgaggactattctagaattctgcctaccacaacaggtttccactgtaactgctgagtggcatgctaggtgttctgtggttgtaggaggctgaaggatatttttttttatctcatgcatttttcaaactatatctgaggggaggctcagcatagaactactggacatttggccactgaatgcacagaagccaacagaaagatgtaaagtcctggagtgtaagctctctattaacaagtcatggtaacaaggaaaggagaatggccagaaaatgccaatgcaaaactctggctacctagtgtggttagactatatgttgaatagctggcttcatccactgaaatatataaggcagaaagaactatctagaaaaggataaagagtaccatatttgggaccttaacactgtagcttggggctccatttcttttagagcagattcttcttgtatttatagttttatttttatttttcctgcttcctgttgctctgctctggctatgtttccactacagttatggctgatcttatgatctattcacttcctcaagttagatgatagtgaaatactgcctggacacaaatcctaactggatacttcactggctacacagctttgggtaaataccatctttcagtctcagttacattacctatacaacacagatagtagtaacatctcagagttgttaagttgaaatacagttgacccttgaacgacataggttagagccccacagaccaacttatacacagacttctatctctgccacctctgagacagcaagaccaacttctcttccttctccctcctcagcctactcaatgtgaagatgacgaagatgaaagcctttatgatgatctacttccacttaataaatggtaagcatagtctctcttctttatgatttttttaattttttttactagcttgctttcttgtaagaattcagcatataatacatatacaacgcatgtgttaatccactgtttgtaatagatcaggcttctggtcaacagtaggctatcaatacctcaatttttggacagctaaaagttatacacagattttcaactgtgggggggccagtgcccttacctctgcattatttaaaggtcaactgcccttaaaatacatcaagctcccagacagtaccaaatcgacattaaataaatactattgttattgacataattagtacaaggtgggtgttatggttattttgctcccaaggtatacccagaatctagggccatgtctgatttatggcatccactcaacacatgactgtcacaattctgtgaagcctctcttcccttctgatctacccactgtataccttgttgtcaaagtgaaaggaacatgtaattccccagcttcgattttcagtggtattttgctggtatatttcattttgcagaatgaaatccgaagtcatggcaaggcattcaaaacccctaccaactttccaaggaactatccatcctcatttcctgaccgactgtgttcacactctgtgttcaggtcatgagaaactactgctgtaacccaaatgccagggtgattcctccaactgcttccttttccttctgagaaattcttacccatcatttaagaatcagcttaaatccttccacttgggtggaggctttcatgagcccatcttccaaagacaagattaaccccttcttctttctgctttgtaactatattcaactactatcctttcaagatttatgagcaggttgacatactatgtcctgtacaaaactatgaatcctggggaggaagggccatatctgatttatatttctctcctcagtacttatccatgtgcctgaaatatattagttgatcagtaaatgttgcagtaaatgaaggaggaatggaaaggaacaaagaaagaaaaaaatgaatggcatgctatctggagggtacaaggaagatttaagccaaaagcataaccctgcaacaaaaatcaccatgtctagaattcaaccattaaagatttaatttttcacattaagcatttcaggtgtcctgaaaataactcaaatggcagaaaactttaatcattaacaccatgatataacagattttcatttgtcacctttgcgcatgaaaagtgagaccactggcaacctgggaacttgaagctggttggcactaatgtgtgaaggctatgttgagagtcagtctgatagcaagtacagaagcttaaccagcaaaatagctagctagttgaactggaaaatccagagttattttaagacaatgcagaacgttccaggacaatccagcaaatcaccaatatgctaaatgatgcttcttcctcctgttttattttctatattaactgtttactgtattgaacattcaaatgcattgtcttgaaataattatgtacttgctaccaccctactgattgatacaggctgccaaattattaaaccaagtttacagaagtcagcttctgttctgggaataactggctcggggttttataatatatattccatttctttaggtacccaaaaatgcccagcatggtattctcaaaggtaacatcagtttgttcttatgagctgctctggccttcacatttcttaggtggccattcaggagatacttacaagacgatttagtgttcttgtgggatataaatgcttgccattagcaaagggaaaacttggcaactggtatggagtatcaagtatttcaaatagtttttactattgagttggattttatcaaactcttaacttacatgccaactatccccttttcatattttaaatccttaatgatttaacataaagtccatcagcacattttgattgatgaacatagaaatcatttttattaactaatatgaagttgtaaaaatatgtttactattctgtgtccaaaaacacctttaataatttctccatgggtctccttattttgagaaaaaaaggtaacaatttatggaggaaatcaaatgagcaaatatctatttaaataaactaaggatttttcaaggggttgttaacgataatgttgacaacttggtaaataagcaaacactaactcctattatacatataaggtgacaatgtgtgactataaagaatagaaagtgtgcatatttatcaagaaatcattgagaagctatattatggttataatggtgctggccttgcagaaacattttggagatcctcttttgagaactgatatggtttggctgtgtccccacccaaatctcatcttgaattcccacttgttgtgggagggacccggtgggaggtaattgaatcacaggagcaggtctttcccatgctgttctcatgatagtgaataagtcccaggagatctgatgtttttaaaaacaggagtcttcctgcacaagctctctaactcttgtctgctgccatgtgaggcgtgtctttcaccttccaccatgattgtgaggcctccccagccatgtggagctgtaagtccaataaacctctttattttgtaaattgcccagtcttgggtatgtctttaccagcagtgtgaaaacagactaatacaggaactgtctttaaatccgatttataaatcatcctgccctgcctgctctagctgacacctggctgccctcagactcaaactttccaaacctcttcaaatcacattttgatgatcactgatttacttcttgtaaacagctttaccaaagagggagacattttaaaaaagacaggtaaaatgacacgcaagtaacttagctattctcattagctcatgtaaaggtttgctagggaaaaagattgaaattaatggttagaataagccttttgtgttatcattaaatttcaattatgtacaatccttgcttacattacctggaataattggaagttcacagcatcattgtgagtcaaagcaatcctaataattaatttcttgctactcaaggtagaaagagcctctataattctactctatttggaaaaggtatcatagattcactattcacttaagccactgactttgaatgtttgaaatgggattttgaaaaggtcatttttctatatattttatcagttatttgcttttatattttttgagagttatgcattgtgtatataagtactgtgccactattgtaccaccaaatagtggaagcgaaaacgacacactactcgtgtttttttctttctaaaatcctgggtttttttgcagtgctttttgatatgtgtcttattaactgcaagtttatacatgaacttaggattcatttgttaaagagcctgagcatgaagagaagcttatttttctcttcatgagtgtaatcctgcagttttacaaggttagtaaaaaccctcttgggtttttatttttcctggacattagaaacatgaagagtctttcaatgagaaattatttgaaagggaattatatttaggccataaacaagctgtgaaaaaaactcaacataatccctcctgttaaaaaggttgaactccagaattttactaaattgataatggttgtacacacctgtgaagaatgaggaacaactctaagcagatgacctatcacgacaatttaaagagagaacttatgaaataagttggagaaaaatgcgctaaaatacattcaacgaggcgcgaattctagcctggcacttagggcctgctctatccacaggcaaaggaaaatggaaaagataaatctaaagggagccaagacctgtctgcttcccaaggtctaccaggcatggcttgatcatgctggctttgcttacagctttgatcatttggttgcaattgacaggtacttggacaaatcatgtctgcagtcagaatggacttaaggaataacaaatcaacagacacatgctatacacagagtgaaccttgccttcagccttgctgtgaacttatgctgcagttcttataactagttttccccttatgtctaaatccatagtttattcctagtacctgcctctcaattacccagaatcttttcctagaaactcttctaatgctaccaccactctgcagctctggaggctgccttctcctggacattccactgttatgtctaggcccatcatatcttgctgaattcctcagaaatttgaatcacctagtagcctgataaatatctatgcacactggatagtcctccccttgtgaaggtaaacttctttctacccatggtcaagaccatccagtatattctcctggccaccctacacagatgcacacaagacacacacacagatccaaacagacatcagtcaaaaacttttccacaacaatcagctcacttccacaaaaacagaatcctttagggtgtgtttttgttttacaaaactggtcgtgtcccactaatggatagcaaaatcaacttgatgagttcatgattagcagtatggaatagaaaagaaaaagaaaaaagaataggatagaactggtgagtgttttgcaaatagaaaaggcattattttgtgaaatccttttcagttatatttatttgtgtttttctatatgttcctggttatgataaaaaatgcacttcttactgtagttcatcatcaggaaagttttctaaaccatgtattagagcatttggagagaaaagcatcatttctacagttaaccttattgaaattgtaaatttgtgatctgaaacagattacacattaaaccagtacttcattacagacacaacaacaaacacaatttcatctgataagcaagttatcttcaaggaagcagataagcagagtttggagggaacaggcatctaaataattacattttgatggcacaatgaggaaataatctctgtgattgaatggtttaccaatttaggtgctctggcctgaaggtgcctggctaagcaggggctagcatactcgggcactgggaaacttgaaagagtgagtcaaggaaactatagagaagggcttggcataggtgagctccaagtgtataatcattctattgctaacaaattgtgttgggtagaactggttaagaacaatgatggtgagatcttatatgtgtttatgtgttagcattttttaaaggatttttctacctactatattgttttagtgaggcatcttagatgcaaaatgtaaggtgatgctcattctcaggatttgcaattaccctgtgagctttgcttgcctggccccagtctaggtcctgtacatgagatatgacagtattgattcctaggccggaagcggtggctcatgcctgtaatctcagcactttgggagaccaaggcgggtggatcacttgaggccaggaatttcagaccagcctggccaacatggcgaagccccatctctactaaaaagacaaaaattagctgggcatggtggtacgtgcctgtaatcccagctactctgaaggctgaggcaggaaaattgcttaaacccgagaggttgcaacaaactgagatggtgccactgtactcaagcctgggcaatagagcaagaatctgtcttaaaaaaaaaaaaaaaaaagaggaaagttagtcctacagaattttagctgaaaggtcatgaattgtggtaaatctgagtttaaacctttggcctcctgagttctggaaaaaatgcattttttaatctacttcaaaagacctcagtaagaacttattctgcatacatttgcaaagtaatgaactggcaagataaagagccatactatggttatttgttatgaaatgtttgttcagaatgaaagaatggcaaaatgcagccagcaaggtttcagccttgaatcctgcatttagtttgaggcacttccattccagaaagacaaagacaaattaaaaaccatttagagaatgataaaaagatgagtagggaaaagaaaggtttgatttatgaggctagattaaaggagataaatgcctattatgtggctaagtgacaaccagggaagataagaatctacagatattgggaagatgtaaatataggtaatagagaagacatctaagtgttctacaagatagaactagtaagaaaaacggaataaaatattaaatgggtagacaatacgaagaaggcttttggcaaaaggattaagtgggtagcaatacaacatggaagatggaggggtaggaggaggaagagggagaagaagggagaataaaagaacaggagtatgaggaagaagaaaatgaaggaagaaacaaggaaggaggaagggaaggaagaatgtgaagagagagaaggaaggagagaaggaaggcaggagggaggcagtgggagaagtggggaaggagggaaggaaggaaagaagggagggagggagagaggaaggaaggagggagggagaagaggagggaaggagaaaaagaagaagggaaggaaggaaaggaaggaaggagaaaggaaaaagcaaggaaggaagaaaggaaggagggaggaagggacagagggaaggaaggaaggaaaaaggtgggaaggagggagggagggagagagaaaaggagggaaagagaaatggtggaagggaaggaagagaaggaaaaaaggaaggaaggagggagggagggacagaggcaggggaggaaggaaggaagaaaggaaggaaaggagggagggaggaagaaaaggagggaaggagaaaaagaggaagggaaggaagaaaggaagaaggaaggaaggagggagggagggacagaaggaaggaaggaaggaaggaaggaaggaaggaaggaaatgagggactatgttttgtcccactgtatttaacagaaaatataagaaatagatttctggcagttctaaggcagaatgaacatctttccagaaacctgagccagctgaggagatggtatcaacaaccaacctcaggggaggaggccacaactaaatcagaaggagacagtaatgaggagctgaagtgggcttgcaaagccattactcctattaagtccagggcttgtgcacaggctacctgccaacttttggctagcctataacacataacagttactgtaattgaaactgaattataataccatcctggcacacattctcccctaaaaatacaacacataataatgctgttaaaataaggacatctggaaaacaatctagagtcccattgtttgtagctggcaccggccttctaaaggagtccttcctgcttcgttcttctactgtataaatggtgacatggtgaaaagggacacttcatttaagtgaatccgaagtttaatgtttgttgagaagcaactagatgccaaacactataccactcctgtttttgttaaataaccatctatgtgattcagattcatatccctgtcacaagattaaaaatctggtgtcaaagaagttaagtaatacattctaaatcacttaaaagataagagaaataaccagaaatagaattctagactgcttgtccttgtcctcaaaatatttccattatatctaacagcaatttgcccaaggcataacatttagtaaatgttcaattaatatgtgcataattgataattgtgcagaattgaattaaagggaattgatggtataactgaaatctaaaaagaatccctaatgacttctggtgatgaattgatgaagtgttgccaaattttcatcaaatgttgaagtatgtatgagtcaattatggccacactgaaaaatggcatctcttttgtaagtatatatatatatatatatgtatatatatatggaatacatgagatatgtatgcaggcatgtggtgtgtaataatcaaatgagatatctctaacctcaagcttttatcctttctttgtgttacatacaattcaattatgctcttagtcatttcaaatgtacaaattagtgttgactgtagccaccctgttgtgctatcaaatactagaccttactcactttatagaatgatattattgtatctattaaccatccccattctcccagccccagtacccttcttggactcttgtaaccattattctactctgtatcttcatgagttaaattgttttaatttttaactcccacaattaagtgtgaacatgcgaagtttgtctttctgtgcctggcttatttcacttaacataattacctccagtgtcatccatattgttgcaaatgagaggatctcaatcatttttatggctgagtagtactccattgtgttaatgtactacatttcctttatccatttgtttttgatagacacataagtagcttccgtatcttggatattgtgaatagtgctgcgaaaaatatgggagcgcagatatctctttgatatactattataacttcctttcctagcagtggaatttatggatcaaatgagttttagtttttttgaggaatcatcaaactgttctccataggggttgtactaatttacgttcctaccaatagtgtactagtgttcccttttctccatatccttgccagcatttgttactgaatgtcttttagataaaaaccattttaactggggtgagaaaatatctcattgtagttttgatttgcatttctctaatgaccagtgatgttgagcacttttcatatatctgtttggcaactataccttttcttttgagaaatatctactcaaatcttttgcccacttttaaggtgtattatcagatttttttcctatggagttgttttgagttccttatatattctggttattaatcctttgtctgatgcagtttgtacttacttttccccattctgtagaagtttcttcacctggttgactgttttctttgctgtgcagaaatattttaatttgatatgattccttttgtccatttttgctttggttgcctgtgtttgtggtatattccacaagaaatctttgcctattctaatgtcctggggaattttctcaacattttctgttagtagtttcaaagtttgaagtctcagatttaagtatttaatccatttttatttgattgttgtatattgtgtaagatagaggtctagttccattcttctgcatatggatatccagctttcccagcaccatttatggaaaaggctctcctttcatcaatgtatgttcttggcccctttgtcaaaaaatgagttgagtgtagatgtaagaatttgtttctgggttgtctattctgttccattgctctatctgtctgtttttatgccagtgccttactgtttttattactatagctctgaaacataatttaaagtcaggtaatgtgattcctccagttttgttttgtttttttcttttactcaggattgctttggcttttctgggtcttttgtggttccacataaattttaggacagttttttctatgtctgtgaagactgccattggttattttgataggaattgcatcaaatccatggattgctttaggtagtatggacattttaataatattgttttttcaatctatgaacatggaatatatttccattttttatgttcttttcaatttcttgcatcagtgttttatggttttcattgtagagatctttcacttccttggttaattcctaggtatttgattttatttgcaactattataaatgggattattttctggatttatttttcagattgctcactgttgacatatagaaatactatggatttttatattgactttgtatcctgcaactcacataatatgagtttggaagtattccctcctcctaatttttcagaatagtttgagtaggactggtgttaattcttctttaaatgtttgatagagttcagcagcgaagccagtgggtcctgggtttttttcttggatattttttattacatctttgatcttggtacttgtaattggcctgctaaggttttgggtttctttgtggttcaatctagtaggatgtatgtgtctgtgaacttacctacttattttaggttttccaatttattggtatatagttgctcatagtagcctctagtcatcctttgaatttctgaatcatcagttataatgactcatttttcatctctgattttatttatttggttttctctcttttttgcttcattagtctgtctaaagttctgtcaattttatttatcttttcaagatacaaactttatgtttcattgatcttttttactgttttctttgttttcttttcatttatttctgctctgatctttattacttcttctactaactttgggtttggtttgctcttgctcttctagctctttaagatgctttgctggattgtttatttgaaatttttctactttcttgatgtgggcacttacggccataaattttcctcttaagactccttttgctatatctcataggtttttacatgttgtgttttcactatcatttgtttcaagaaatttcttaaatttccttcttaatttctttattgacacacttgtcattcagaagcctgttgtttaatttctatgtgtttgtatagttttcaaaattcctcttgttactgatttttagttttattctattgtggtcaaagatgatacttgatataatttcaattgttttgaatttttacagacgtgtttgtggcctaacatattgtctatccttgagaatccatgtgcttagaagaataatgtgtattctgcagctggtagagataatgttctgtaaatatctaaggttcatttagtctatggcagattaagtttgatgtttctttgttgattttctgtctagatgatcagttcaatgttaaaagtgagtgttgaagtctccagctattacattattgtattggggtatatctgccattttagctctaataacagttgctttatacatctgggtgctctagagttggatatacatatatatatatatatacatatacgcacacatatttgttatacccccttgctgaattgatctctttatctcttctttgttctttttatagtttttgtcttgaaatctattttgtctaactgtagccaatcctgctgttttttggtttccatttgcataaaacatcttttttcgtacctttttttttcagtctatatgtatctttacaggtgaagtgtgtatctttacaggtgaaatgtgtatcttgtagacaacagatcattgggtcttgtttttttgtttattttattttttttaattcagtcgtctactctgtcttttgattggataatttaatccatttacattcaaggttatcattgataaatagagacttacccctgccattttgttatgtgttttctggttgttttttcggttttctcttccttttttccttcctttctgtcttccttttagtgaaggtgtttttctctggtggtatgttttaatttcttgcttttaattttttgtgtgtctgttgtaagttttttgatttgaggttactatgagacttgcaaataataccttataacctattattttaaactgttgttaacactgattgcataagcaaacaaacaagcaaagagaaaataaaagttatgcattttaattcctcctctttttaaactttttgttgtttctgtttatatcttattattgtattgtgtcttaaaaagttgctgcagttatattatttgatagacttatcctttagtgcttttactcaatatatgagtagtttacacatgacgattacagtgatataatattctgtgttcttaatatgtttttctgtgtgcttactattaccagtgactttgtaacttcatatgatattttctcattaacatacttttctttcagattgaagaactccctttagcctttcttataggacatatgtggtgttgataacattcctcagcttttgtttttctgggaaggtctctatttttccttcatgattgaaatgtattttcaccagatttgctattctaggataaatttccttcagcactttaaacatgtcatgccaatctctcctgtcttttaagatttccactgagaagtctgatgccatacatattggagacctattgtatgttatttgtttctgttttcttgctgcttttaggatccttcctttatccttgacctttgggagtttgattattaaatgttttgaagtagtgttatttgaggtaattctgcttgatgttctataagcttcttgtacttgaataatatctttttctagtttgggaagttctctgttattatccatttgaatcaaatttctacccgtagctctctctctatatctcctcttcaaggccaataactcagatttgcccttttgaggctattttccagatcacgtaggcatcctttgttcttttttaattctttctgatgtttttgtcctatgactgaatattttcaaatagtctgtcttcaagctcactaattctttcttctgcttgatcaattctgctgttaagaaagtctgatgcattctttagtatgtcaattgcatttttcaactcaagaatttctgcttgattctagttaattatttcaatatatttgttaaatttatctaatagatttctgaattccttctctgggttatcttgaattaagttgtgtttcctcaagacagctattttgaaattgtcatctgaaaagacacataactctctctttccaggattggtaactggtgccttatttagttcgtttagtgaagtcatgttttcttttatggtcttgattcttatgggtattcattgctgtctgggcattcaacagttaggtatttattgtagtctttgtggttggcttgtttgtacctgtccttcagggaaaggatttcaaggtattcaaagagaccttggtgttgtgatctaaatttttggtcactgcagccacatctgcattagagggcatcccaagtccagtaatgctatggctcttgcagattcatggagatactgccttggtggtctcagataatttctggaagaattctctggattaccaggcagaggctcttcttctcttccctcaactttctctgaaacaaacagagtcactctttgtgtgctgaggtgcctggagctgggggtggagtgacacaagcacctctgtggctaccaccagttggactgtactgagtcagacccaaagacagtacagcactggtgccttatttactttgcccaaggcccacagtaaccactgcctggctacctgcctgtgttcactcatttctttagggcgccaccatcagcctgtggcaaatccagccaggcttatttccttcccttcagggcggcaagttccactggtcccagacaggtccagagatgacatccaggagccagggcctggagtcagaaacttcaggaatctacctggtgttctattctactgtgactgagctggcactcaagccacaaaacaaagcccttcctactcttctctgtcctttccacaaacagaggagtctcttccctaggccccaggccaatggtgagtaccacctggctaccccaggtgttcactcaaggccccaggctacttcagtcaccttgtggtaaatgctgctgggccatgactctccattcagggcagtgggctctagcccagtgcatgttcagaaatgaaaaaactgcatttcttgagagcaaagtatctttgccttctttggtatttaagttatcacaagtatatactaggcttcctcagtcttgcaaaagcaaaaaataaacctaacatctgaataatttcaataagtgctaagtctgtgtaaaacaatgcatgcacataataatgactttatgccttctacgattgtatgctgactgataaataatactgacaactaatatacaacatttaattatctacaatattaaaaaatactgttttatatacttccaagaggatacggaaaaacatacacagtttccatacttattgaacttatgactgtactggcaggcaggatatgaatgcatgaaaatataaaaataatcaagttttaaatacctatttgagattttcttttcaatagattttactctactaatatttatggaatacttactacacatcagagcttgtgttaggtatcagtatacaagaaataatacaatgaggttatttctttcaagaactccaccatctagaaggggaggaaaactttcaaacacacagttccaaaacatcatcagcagtacagagaacggtatatggtgctatggaattcagataaggaaagccttaattctgctgacagtgggtctgaaggtttatcaaggaaggcttcccaaaggaggcgagactcacattaggtcttgaagaatgagagtttcccaggccaaaaagaaagagcactccaagaagaggggatattacatacaataccatgcaggtagaaagattatcgaagagggtgacagactgggataattatgataagcattgttagcctaattactgttattcaatggggaagatgatataaaaacaacctaaaaatgtcaattttacattttttcaggtctaccagcttgtcagtataaattgagatgagctcaaggcctccttaagtagaatcttaacatggcaactaacatattaacaggtttcccgttcattaccgtaggataattcattaaaaaacaatgtattcagacttcataagcaaaagcataccttcctctttagtctagtatatctaattatatgaggactgctattaacattaaataaatcatctaatagataatttaaatgtgcagtagtgttcaaaagcaagtctactttttcaaaagtaatcataattgcagcagaggcatcacgaaatatttgattagtacaacgctaaggagtgagaatcatttcttacaaatgtacaattaaagaagttgtcaattatagcataaattgatcagcatgtatatgatacaaaaacatgttaacccgaataagtttagactatcagaactactgttgtgaaatattcctttgaagcattgactgtaaagaacacagtggaatcaaagttataagagctatagataataacatttatagttacagaattctgattatatgaattccatgaattaaacgttgcaccatccactttcatacaaaaacaaactggataaatgagtgatgacattcattttgccagtttacaaggtacagaaaagctttgtgtattaattctgtcaatgagaaaataataaataattttgtatttaatcctatttgaatttaattgaaaccctatagagcattccgcatgaatggttttcaacaaaaaagtgatgtccttaaagaataaggagcttaacttcctcttcaaacataagaagcagtgccattgaacttgcttactcttacctcaagtgaatgattacctcttgcaaatgaattttagcagaattttccaactccagcctcagttgtttctttttgctatttgttttgttgctttttgaaataaagcttctcttccttgtgctttgcccatcacttgtggcaggaatcaatggtaccctaaagataccgactcattggtgcagaaagctaaaacctgcccctttaaagcccaacctggatcaggaccgaaattaaataggattaactcctaatttgttcctgtgtcctactcttctattgactgtttcccagtccctaatagttgtccttgttcatgtgtaagacactgtgtcctcttcttccttagttaattgagtctttcgttttgactttctattctcaactttgactatttttttttgctctgtgggctaaaactaatatgcagatacagttttcccttcctgatctcaatagttcatagtttctattgagcagcttatactacatgtcacttcagagcaatttcctttaatgcttttatgaaatttccctcaagatgctttttaaaatttattttgtgtcttccttcccttcctttcttcccttgttctccctctctctcaatccttgcaaacacataaacacatatacttttactacattatcatgttcctgttgatattgtctctaggaatttcatatgcaagtatatattttgtatctcattttgacaacatgaaatctatgcacaaggagtcatctatttcctttgcccagaagctggggcccagtaaattgtattgagtaagcaaaattgtttggctcatttattcactagtttgctcattcattcaacagatatttattaagtgtttgatatgtgtcaggtcttatactaagtgctgaattcaataatcaatatcgtcacaagaaatattgccttacatatgtcctttttatggaacattctcttctaccttgtttttctagcaatttctgctcatctatcatgattcaacttaaatactaggttttccatgaaatgtcttctaatctttagacgtttatcagtttcttgtctttgctgtcatcctagaatatgggatgtttcatatttcacagtaattataaattcacatgtctgtttcctcccaattagactcactttgtgggaagagacatgatctcttccccagtacttgtaacaatgcatggcacatagtaggtccttagtcatttgtatacatgataataagagcatctatgtgtacaaaatttagtagaaagtcaacatccagcagtttaatagcattattcataatcaatcccaaaacaagtgattccaaggatctataaaattttaaaagctagtgttaatccagacaagtttatttacataaaatggaatcagaagcagcaaacttgattgccccgtcctctagaatataacctattcagaagcccattggaactttatattaacccctctgttgggaccagatagatactataagctaattaatatggtatattatacggaaattaacccaaggattctgatttttttttattgttagaagaatgaaacatccccaacaatttgcctatgcccattactatttttatggtgatgactccagatttacacctccaacagcattccaagtctcttatccatctcaatggataagacatgggaccagttatgtcccatggaataactcagagatattgtaaacattatctgtttaaaagagaactgtcaattctaccttcaaacctcccttcaatcccctctctgtaaatggcactgtccaacatctcaagtcagaaacacaggcacagcaaccctgacttggtcttgattccactttttctatctccactctcatccaatccttaacaagccctgctgtcttcatcccaaatagattaaacccttctctccatttcctgtaatgtattacatcagtggagagtcccatttcttcctgtgtttagtactgaaacaacttcatatctgtcctccttgtttctgatcctgctgtttccaattcaaagcgtttcttaaaatgtgtactatatcatactgttcctcaaaacaatccagtgacttccaattttatttagaataaaatttcaaattctttttatggtttatcaagtattacctgcctctctaattgttcttacaatgtttcagcttcaattattttctttgaactcctgtaatacaccaaggtctttaccagctcggagcctttgcacaagctgttctttcttcctgaaatgctgtttccctgaagtcctttcattattggttctttcttagcatttggacctctgttcatattatctggtcatgctcttgaaatagatgtcccttcaatcccacagaaacatgtaatttttccatttttgataatttgattgcttcttaattctcaacagaattggtgattttgctttaataatacttgtctttattcatgtcttacttgttttccctcctagagtataaattttttttaggcaagtactctgcctcccttgtaagtctttttacccccagggaccagtatggagtaaagcatctaaaaaaatgtgtgttgacaagcaaatgtgataaaataaaataacctaaaattaaaaaaaaatcagtaagccttaattgaacaactactttctgcacacagatatatatctataaattcatagacctttaatattcacaatagcactgtaaggtacgttgtatcattctcatttaattaatgtgaaaagcaagtttctcaaagtgttagtacaacttttggattttaatgtaagttcctgaatctaatcccagtcttttgtattttttcgttctatactcccaaagccataatttaatttaaatatagtttttacctcttgctgacatttaaccattaaatttttttccaccagttaaattaaaaagaaaaaaaaagtccatggcaatacatactggcattctgtctttgaaaacaaccaaaaaaaaatcaataaaaatcttctacataaacctgccgtaataaattaaagatgtgttaaaaggaaagaatggatgcttctgttgataaggatcatggccagtggccaaaaggcaatcttctgctgttctttaataactcggtgcaaaaacttcggaaatttttataccactactctatcatagcactttagtaatagattacaggaagtaataagcatgttattttcctaagtgtgctaaattgtgaaacaaagagttcttcatccaagtgcctactgtctgttgcaaagccagtttaagaaaccagctacaaaaactcatctttttttttaaatccaataatcattcatagaacacctaactggcaggcagtggcatggtggttgagagttaaagctcagaaatcaagggttcaagtctctcctccactctgtgccagctgtatgacactgaataaattattcctttttctcattattaaaatagagttaataataatgtctatctgatagggtcatggggggaataaaagggtgaaatgattaaaatgcccactatgtactaagatctccaaaaaaataatgttaactttggcttcagaatgatgtgttctgaggggcataagtttatgatactctgggtgttgagaatataagtattatggaagggagagcaaggtacccggcagagtgaatggagttaaataaccttaaggtcttttaggaacaagctattcccttaccattttttaaaatagctttttttgaggtacaatttgcacatcataaaatttacccacttaagtgtacaactgaatgatttttaggaaatttacagggttatataaccatcaccaaaatctaacatcagaatgttttcattgcctcaaaaagattcctcatgcttacttacagtaacagccgttcacacccccaccccaggcaaacactagtctacattctgtctctgtagatttgcctcttctggatattttatataaaatgtattatacagtatgtgatcttttgtgtgtgacttctttcagatcatataatgtgaaagtccaactctgtggtagcatgtctcagtttgcttctattgctacatcatgttccattctgtcaatataatacattgttttgatcaatcaccagttgacagactctggagttgtttctagattttgacttcgacaaatcatgctagtagaaacatttgtatacaagtctttttctacacctgtgttttcatttctcttcagtacattcccaggagctctccttttccattttataggaaagctctgcccctgaaagaccccagtgcaacttgttggaagtgggtagagttctaattccaactcaccagtaactactgagtagtcagctcacacaatttagtaggaaaaaaaaatacacatcagttcttgtctctgccctttttcccctaaatccccttgtgactttggaagataactggacctcatagcatctcggcatcttaacttgtgaaccaacggctgcaactagatgttctctgaactcttttaccttaaaaaacttataatgctcttagtaactaaaattttataaagaaatccagaaagcacaatcaatggattatctcccttgcccctgaaattttctgggcatagccagcacatagcacagtcacaaaaaaatatgataccgaaagcatttgaatattgtctattgcatgcagaatccaggatttaccagttgccaccttacacgtgcctgttttgctcttaaaattcttgcatatcactgtatttatctgtccacattttgctaaggcagttattttgttcagagttaagtgggcataaaacaaacattagtacaagaaaataggtggattgttttaataaacatttaaaaagtataaatccaagtaactactgttacctccaaaatagtcacctcactggatttacatttctttattctgatatcactcagagtatacttggatatttccctttggaactgccctccaaactagtggtatagccagtttctaaaattaattttcaaaccttattatgaaatgtttagcttgtagaaagaagtataaagaataatacaacaagcatgcatgtaccaatcacaaagctttaaaataattgattaccgatgctctggggtctattagtaccctctctactttctctgtccttatctccaataatttctgcacttaagcatgactgtcctcacacatatatttatatttttttgcatgtggatgttaccctatgtaatatatgatattgctttcctagtttgaatatttatataaatcgtatcaaaatggtatcaaactatatgtattatttatcagtttgctggattcactcaatatcatgtttggtgaatttatttacattgatacgtgagttctaattcgatattcaccttgtataacattaaatttttaataaaccacaattatttatcctatttcctattgatatatatttagatgatatctagtattttgctaccacaaacactttagctgtaaacattcttgtatctatcttctctgtgtacttactgaggggttccctagagttacctttacctagagtttcattacctaggaatgaaatttccagatactgagaaatgaacaccttcatttttactaattactactgcattttctccaaactacacccatttttattctattcatcaaggtataaagctcccatttgtgcacatctccccaaaactcagtactgttagacattttaattttcccagttgccaatttgattcttaaatatcaaatttaaccaacaatacatgactatgtcctctgaatatacctctgtgcttggttctgtgtggaatgcaaaacatgatatagtggcagtactactgaaattggaggaaccaaaaattgagccctcactcctgccgtctgtgaaaacctgagcaagttgtttaacctcttcaagtctcagtttcttcatctgtaatatgaagggatggacaggaaaaattttcaagctcctttcaccttccgtcctacttgactttatgatgctctctgggagcttataagactggaggagatgcaaaacacacatacgcaactttaacagcacacctaaatatacgtgtagaaggtactgggagaacacagcacacaggatctaaataggggtgaggaagaaactagaaaggtttcaccaagcagattgaatgagattcaccaagatggtatggatggaatggaggaaagacatttaaggagaggaaagagcatggcaggtggggtcgtaaaagaagacagtgaagggagaggggcaaggatagggaaaggggcaaggatatggagagaggcaaggatagggagaagggtgtggctggagcaaaaggtgtttaggtacatgctgggaagcggagaagatgaggccagttatattgtgatttttattatgtcaaactgtaataaatcttcattatgttatcgataacttgatttttaaacccctcaaagcaatgtggaatcaaatctgcaaataaggcagatagtcattttattttcactttaaaatgatgccatgaaaccaatttcttctgaggccaataggctgattctacagtcacttctcaagcagggctgttcagggggtttgagaaatggaaagaagcattgcagaaaaaagaatggagtctccttgcgtgcaagctttgaacagacatgctcctttggatttttgaattttatcaggtggtttaaaagattcattattttatagttatacttggtattgaaaattctcagaacctgatagaattttagtattcccacataaaatttttaaagtacaaacttctttttttattacttagaggaaaaaaaatgcctcctaagaggcttcaactggctatgctagaatggctgagaattttgaaaaagataattaatgtacctcattttgaataaactgatttattattggttataaacatggacctcacaggcaaaatacctggcttcaaatctggagtttcctattgtaaagtggaatattaatttaagcaagttatttaagatcagtttgttagcattaggattgcgtttggctacatgtaataaaatacctaaatcaatttcttccacccgtgtaagtgtcttgtttttcttatatcataggaagtcagaggcgggctgctgaagaccggctctatggtatcgctagtgacccatgctccttccactttctgctccaccattctggatatgtagcttttgtccttggcttcaagatagctcctttatcactaagcattgcttctggatttgaaaaagaaacaagggagaatgaaccaaaatccctccctttgtaagactttgtatttttaactcgggaggctgaggcaggagaatggcgtgaacccgggaggcgcagtttgcagtgagccaagatcgcaccactgcactccagcctgggcgaccaagcgagactccttctcaaaaaaaaaaaaaaaaaaaaaaagactttgtatttttatccagaagggtaccccactcaagagacttacttaagtcccactggctatacattgtgacatgggaacctggaaaaccattttttttaaatacattgctgagtgcatagtgcattgctatcctaaagaaaatcaggaatcttttagtaaatgatgtctagccaggcatactggcatgttcttgtagtccccgctactcaggaggctgaggcaggagaatggcttgaacttgggaaccaaaggttgcagtgagctgggattgcgccattgcactccagcctaggtgacagagtgagactctgcttcaaaaaaaaaacaaaaaacaaaaataataaacaaaagcaaaatgaaagtcatagcatatagtaataattcaataattcttactacccaaaggattatactaatgtgtaattaataatgttatatatataaatatatatattcctccaagcacacgttaatccttcgtggcccagatcaaataccacatctactaacacccttctctgattctgccactcagattctttttcttcatcacttaatcagttatatttgatgaaacacaaactaatctgacaagtaaacgaaaaaggatcgtattggaaagatacaaaactatagaattcagagtagagttagctcctgtaggttctataggaatctatagaaacatgggaacctaaataagtttcatgggggtaaacaccaccgagcttatgtttttagcttcttgagctaccatagcaggaagtaagtccttgattcctaccaggatccacaatgggattgctcttaaataggcaagtgctttgctgctagacagataaagcatgatcgctgtctactatagggtcacatgcaggtaagtggttgactttggtcaaatgacactatgatagctcagtgttatccaattgcagaaatgcctatttgttcactgaaattctgctgagtaactgtaataagaatgagaaggcaattgtttcagagaaaattgtgtgaataaatttagaagaagtaacacacggttttaattcatagaatgacaggtggaatgatacagtttagacgtaggatatggaaaggcacttactagcagcttacaaagcaaaacaactcgtcaacataatatgcaaattgaatatatttgaatagtagcatgacaaggttacaaccataccttaagagactttttctggtctgttaattgtataaagaagcagaaacaatttcctgaatataggtaatagacctaactatgggatctgaagtggggataaatagaaagggaataggtgggaaaattaggaagacatagtggggaaaaattgcaattggagattatatttaagaagcaaggatggaagctttcaagatctcctatgatttcaagcttgggtgaattggtgctgccagaaaagcaatggagaaacaaaaggcatgataggcagaggaagaagaaaagaagatgcatgtcatgtatgttgagtttgacatcccaatagaatatctctgagaaaatattcagaatttgaattacataactggtgcttaccaaagaacagggctgatggtatagaaaaccttttgcctttcttataattttctacagtttcctctactcttgtattctcatcaatcactcagttattttgcacatgtctagttctatgtaatttctacatttgtctgtataatgttatctttgtaaggtgacttatctctgtacaccataggcactattttccctactttacaagaggaaattgagtgtcagaaagagcctacttacttttcttcttactaacgaatgaaaaggcaatgttaatcatcatttttccccctaatcggtgagctatgaaaaaaatttggggtccatgcaaaatcatcattattatgtttaaactgtaactctacaaatttatgatctcctaaagctttccaagatgtagtatctctctcatctgttggcagatttttcaaatgaattcctactcaatgaaaaacagttcatttacattttaaaaaccttgtcagtattaaccagattattccttctaattattctttaggtctgatcttaggaaactatttgaagccatctgttatttaaattcaagtttattgcacgtaaaagaacagaacttgatttatgttatgtctgatttgttctgatatgtatagaataataacttggcaggatctcataaacagcagttatggtatagtacaaggctgtggtataactgccactgagattcattatcacacacatcttctaagggcatctaaagggcataaacatttcagaattctgtctgtaatcactatatgccctgctgatatgcaaccagaaaaacattctactctgaaaaaaaaaaaggtatatttctagttttcagaacacaaacttctcagatacacaaacaaggctgcagtttagtgtgagactcaatggccaagtatatttgtgggaactaaagcttcagtggaaagaagcattaggtggatttttcagatttgtctcaacatggccagctccgtatattacacagtctatattctatgtgcatagggcagataaaaggctctgtaatttgttaaatagtatcccaaaatattaacatcggtgggaacctcagaatgtgaccttattggaaaatatagggtatttgtggacaaaattagttttgtggatggatggatgaaagtgggccctaatttcaataaatggtgttccataagaccatgtgaaaacacacagcggaaggaaagctatatgacaatagagtcagattttggagtaagtgacaagccaaggaacactgaggattgccaacaactactagaagctaggaagagggagggaaggatttttccctagagctttcagagggaatatagccctgcagacacctttctttaagacttctgggcttcagaactatgacagagtatatttattttgttttacgccacccaattttttacagcagcctaggaaactaacactggttctaaatgacaaattgacaactctaattctgtttgcttcccttacataagcagagaaccacttaaggtgataccatctccacactcctcccatatccttggcaagtaattgtgcaaacatgtggataaaacacatgcattttgatatctttatgcaaaagtgtcttcaaataaaaaataatttaagagaaatgctaatcaagtttaatattacattttaaatcatttcctttcattaacaattcttattaccttcctaaattgcaaattattggcacccaagggacccaagggagtaagaagagtatgacatgatgacaatatctccttcttgaaacacttaaattaaatcataataacctgcaccttttgcttctttcttaccatttctgagatacatgaatcagttcttggcctcaagtctttggcaaagttttggtgggcttgtttacaaactacaaatgctttgtggtttctgctatcaccacagttttgatggccccaaatcctcaatcttctttatcattaatctgatttggagcctgatatcttcaactgctttccgtagttgactgacttgttacttcaaactgaacattgtgcagaatgcgagatctgcaatcaacaaggtgctatttggtaatattaatcacattcttttctttgtgcttgtgtcccctcttataaggactatttttcttttctgccccataccaataagaaacaaggatgcaacaacaacaatgacaacagacctaagtggaatcttggaagcatgcttgcaaagctcatgcttccccctgcataagctagctaagacaaggcacggggtaggaagaaaagagacaagattgtgactcaaaagtgtagatggaggattcaccaggacagacccaggaaggtgggatcctcaaaatgctagaaaaagaacatccatctcaagggtaaggagaggatgaaagagagacaaaagaatagattcatcccctaggggtaaaataattgaacgtcttgcatacatatataatatatacagcataggaaaaaaagttacttgtgactattcaaagctatttttatatcatttcctttaatcttcaaaaaactcattaataaacattgtcactattgctcactagaggaaattgaaagcttaaacatcatgcccaaggacacacagctactcactgctggagttagaacacacttcctctgacaataaatccactgtcctctttccaatttactttagtttataagccatgatttatttgcttttttctgtgctctgagaacttgataagtaaaattacaaatgccttacccaatcattcaaggaaaaaatgtattcaccccttattctctactaatttcatatatgaaacacctaatcgtgttgctaggctcacagcttgctatatcccctacaggaaagaaaaaaatcctgccacttacgtatatgcactttttttttcctctctgtgaaatgtccttttcctgatacaagtcctccctaaatgtcaatactcaaaacacatcattctctgtccattttcttagctaaggggcagtagtctaggtgaaggtgatttaagcctagagctaaggagccctaggtagtatcatgtgttttgaataaaaaactgttcatttttttttctgagccttgagttctccttccaaggactacttcctgctctccacttccataagaaaatgcttcagcctgtttggaaccagcaacataagaatagagaaagaaagggtttatgaaagatggacccaattatagcagtctgcattttcttataatactggtgacagcagcaaacttgtgaagctgcttttaagtctatgataaataggcttaaatagaaaaagttctgcaggtccaaagtcaataaaaatgtacataatgtacttggagttagatagtaaatgaggtcacaaatgcactgaaagtggaactattggaaagccacaggtatatttaggtagatactacttaaaaaaggaaagagagaaaaaaaataagaaaaagtgaggagagatgccagaggaaattcggaaagaaagaaatctatgtactatgtcaacctctacctttgacagggaaagcatctctttagggagttatacatccccatcttgcaagtttattatctctcctcagtcagtaaaatagcttctatcatgttgagcctgttctttattctccttgaaacaattcgacccatagaataaaaatgctgcttgtctatgaaagtctttaccaggatccatgagcccagggcatttccctagaagcagtctttctcaaatttattgtccatgagaattacctaggaatcacaaaatgtacactttctaacttcacccccagaaagtctcagggggagcttcaaacattcacatttttaaaggtcccctgtagattccgacgcaggctcttttttgccacacctgaaacttataggcaggaagaaacaaatgctcagagcccttcctatgtgccagttatagttccaagggctttctctgttctcctgtttttattaataactcattaaattatcacaaccacactccgaggtagatgctatgagacccattttaccaatactggtaaaagtcacagttagtaaataaacataattcaagtctctggtctgtctcattgctgtgccttttcactccatcacataggagtatgactgtctaggaaaataggttaacagaggagacaaagaactcaggaagcatacagttatgtgcacaagacatgtgctgacaaaggactataagtacagtcaataagaattagtggtggattttccaataaccacagaccctgataagtctataggaccaacctacaaaaggaagttgggtgttgggtgaaggactttattggaatccatctaatgtggactgtgagagaaacgttaagttgccaaggagaataaaagcttcatgtggcttgttcactatgggaaaggaaaggtcaagagaaaagtgggacttcagaggatgaggagtgaaataagccctggagccatctgtggatgtagcataagatccataagcacattatttcataggatttgcaatagccaaaggtcttggaaaccaaattgcaaagatcaggagagagttttaagaaacagtggggcagataaattatatttgttgaatctaaaaggagcagccaccaatccaaagaaaaaaatggaatttattgtattctgctaattctgagacagataggtatgatgcaagaaaaagaaaagatggaatgaaccaatcccagctgacctggcatattcccaggtactttcaagtacgttatcttattaaagcatcacaaaatccccgatatgtaggcagaataggcatcagtattccaaatttccagaaaaggaaattaaagtaacaatattgattactgttgttatttttaaaggtaattcttaaagtcatgttgttagtaaatgtaggatctgggactgcccacaggcattctgactcctatgttagtgctctcttcaaatattgacatacacagaggcatagatactacagaactcaagtctgacagaaagttctggtgtccactgcacctatgtattgtgtaggtgtgatggttttaaagatacatccatactgttttcgatattcttctcttccagtggtggagtttacttccccttgccttgagtgtgcattggacttagtgacttgcttctggacaacagaataatgcagaagtgatggaatgtcacttctgagtttaggttataaaaagactgtggcttctgtcttgggagggctctctcatactctctccttcttggatcttgctctgaaggaaaccagctgccatgcatgaggatactccagcagcttatggagaagtccatgtggtgaggaactggggtcggtccacaaccacctgagtgaacctgaaagtggatcttcccctcactcaagcattgagttgactgctggcccaaccaacagtttgtctgcaacttcatgggagatcctgactcagaagcactcaattaactcatgaaaacggtgagataaatttttgttgttttaagccactaagtttgaggtgatttgttacatagtaatggataactaatatagcagggaatcaaatgattttcacatcacaggcaattctgatttattaatcaaaccacatatttaaacagaaaaactttgtcctactccaatggaaacactttttaataaaaaaaaattagagctgtagaaataaggaagctttgactatcagggaaagcaaatggaggctgatggccagggtatgctccctgtcaaaagctggcctcctcaccaaatcacctcaacattgctgaacttgttcccattttctttattatattagcagagaatgcacaaattagagatttaattgagctaacaaccatctccttaaaaatatgaaatttctctgagggtgtttaaatgactagttatccactcattagttagaattaaagcccattacgctcctaataactcattgctaaaatggcctgtgttgagaaatggaggatttgatgaaggcaggtggcatggtatgatttcattttggagcactgtgggggcctgggtagaggtccacagtgggctgacactttggaaaggaatgatgaagtggagagaggcatcctgggtggagtggcacaatgccaaagcccaactcgggcagtgtaatatatatatttaagatatttaagatatcttaaatatatataaatatatatattttacactgcctgagtgtgtatatatataatatataatatatagaaatctgtaatatatattatatatatagaattatatatataatatatattatatataattctatatatataatatatattatatatataattctatatatataatatataatatatattcacatttgtatatatgtatatattctatagtgcctatattctatttatagtgcctataatagccttgtagccaagaataaagagccttttttctactttaaaattaacctggtactcttcatatcatgagttctaatgggccaccctctaaacctaaccaagattcgtaacagaatttgatgtggaaatgaatttcaaactcacactaacaaataggatttggaagacagcttatttgtaagctgggctaaagtctaaagcacagtgccttaatgtggaaaacttagactcacaaacaacttttttatggtgttatcttttaaattttaaggatctttatgcttcactcaaattacattctttagtacattgcttctcaaactttattgtgtatacaaatcacctggggaatcttgttaaaacatggattctgatgggactgaggattatgcctttctaaaaagctcccaggtgatgctgatgctgccgaaactcagaccacacgtacaacagcaaaactataacatacaatttaagagagcaactgtagattttccaagataaaaaagatgactcaatactgcacctcatggttttaggtttttgctacgatcaaaccaccaaatcaacatgatatttaatagtgaaattcatacttctagacttaaacctaacatcattttaattatttttaaatttaaattctggaacaccaatataatggttaagaatataggtttgaagttagaaacacatggattaaatgtttagttctgcaaccttctagctgtgtgacctgcgcaagtgaactagactgagcccaataaagagaaaaccacttcagatatttcaaatggaagagatttaatatagggaacttactgccttggtaatgttaatgcttaggagccaaacaatgaacaatgaggctaccaggagagaatcataatagctagataggggaagccattatcttccctgtggctagaggaaccaaaggagcaggcaatgctgcagtagcctggtggaagctggcaccccagaggctgtccacagggagctagaccctcataggatatgccactactactagagacactggtgaggtgagagctgggaattactctgtctgctctcttcctcccacccttcaatctccctccagtgtattccatgagttgaactcagccatacggctgtcagcagggaagtctgagaaatgtagctccttgtgatgtgaagcagagctagggaggaacaggaaatcaatctgagagcaaactggcaaaggatcaacacagtgagttactgatgtgctctcatactatatccaacgctctaacaggcatctgcagaatatgggtgttgtgtatttaagtaagatgttacatataaagcatggagtatagtgcttggcacattatttttatcagcagcagcatctttttgtaatgtgacagcattttcccccttcattccttcctctcttctcacccattttcctgctgaataagagtagggatcatgtggagtctcagggagataagaaataataaaataatacatccaagctatgccatgagaaattaagaaaaaaaatctgcttgttccatctacatgatagaatcagaaaagcttaaaggcttccactgggcacacagcaataacaagttctcagtgatgtagacttaggagtcatgctcatacctgcaggccgcttaaggaccatcttttggattgtgctgaagacatgggagaaaatgctttcatccacacataaaggccagctgtgtggcctggaaagtgactcaatggaaaggggcagttattcatggtatccttacctggatttcaggagtattgagcttgactggtatatcgatttttttccctcttgactaggaccatatgtgcatgcatttccagatgctgtggtcataactgagaagatatattattatcaagtcactaacagtcttcaatgatgaaaagaactgtttttctcagtagacttgttttccaagttaagttatcaaaagcttacaaaatagacacagttgtctctgccaggttatactgcaaagaaatcagagtgttggcaaatagctcctctgtggaagaaaacataagcaagcatatttgtattctggcctgtgctcctacagcatagggaatgcagcattctgtttagcagttccatcctggttcatcttgtttgggagttagcaagcaaagcctgtatacaacataacagtctccccctgaagacaaccatcacagcttcagctaactcattccaaccttaaaccaaaccatcttaatatagaactgtttaaatagcaaaaattttatggagaagcccattaagttatttataaatgagaagcccaaatgtatagctctgtaatacttcagagctgcgctatgatattttacttattcattacacatttattgagttaaaaaataaacacaaagcaacaatcctagagacttttaccatctggcctatgctaggagccaaaataattggtgcagaaaatgagtgccatgagttctggggaaagagagttagctgtgggttgaaggagtcagaaggtctccaaggtagagaggaatcaagttgggttttgatagtttggttgaagctggccaggtggaacaaatgaaaaagatgcttctgcctgagagaattggctttgtcaattactttgtggtgggaataaacgagttggttgagcaaggagattaaataagatatggttcaagaacctggaattcatagctagtctggctaagttagaaccttgccttcaccatttagtaatttataaataatattggctgcatcacttaatctcaatttcctcaagtccaaaataggaatagtactagtgcttgattcatggggttatttcaagtatctacaaaacaaatacagaggaacaacctaacatattgtaagtgctcagtcaataatcagctgctattatcacttccttcttccaacctatattgagtgcctgctatagagaaagcagaagagtaaattgagtcagaatatgaaatgctttgactgtaggtgaaagtacagacatgttttcctgctgaaatagaggagtcgctggagacactggatttaggcagggacatgacaagggctatttttaagaattaatctactagtatagtgcatgcaatgtgtcattcagcagcgtcttttataaacctttaatgaagccgtagagaaaattgagatgaggaatctcttggcaccatagaaggcatttaattactaagtaataaatttgggggcccttacaaataattgggattcccaccagtgactagttataccccaaggaacatacagactgctaacatggcagccaccagagccctgggtgtttctgggttcttaaaggtagagtgtgcaggggcaggtaacccacagttctccctgtactcaaaatgtggagcaacaaattgcaatggaagtagctaatatcacaggaaatgtggctatcgtctcttcagggtcttcaagtatggggtacaagcacaagggctagcattctcagggacattaactttgatccaaagagctagagcagcagttctcaaacttatgtttctgtgctgatttacgtaatggagtttctcatctagaaaacactcctgtgggtggactagagttatgagcaatgcccagccagctgcctttaactctacctccttctttctctcaataacatgtacctaaatgaaagtatattataattagagaaataattactctaatttatttattaataaagtaaattattcaccaattttggtatgttatcattagtaataaattatttgggaatccaaagaaaactggtatgaacataccaggttatcactgacattttaactaagaattttgagtccaaagactacttgagtcatgctctatcattcagcaacgtcttttataaacttttaatgaaggagtagagatgattaagatgaggaatctcttggcaccataaaaagcatttaattactaagtaataaatctgggtgcccttacaagtaattgagacccccaccagtgactgaatataccccaaggaatatgcaggctgctaacatggccagccacccaaacgcccagttatttatctggcaagtacaaggcatgaaacaaacttctggactcttttctctttgcagactccagtatgaatggtgaatgtaatttaatgtgtcatggaaatgcagagctgtagaactgattattatgcccagtataaatggaagagctctaatctacgagtggaggtgaagcatccccagtggccaggaggacaaccttgcccagtgacctttcctagaagaaggtattgaagtgctaagatgaggatttccacaaatttctgctcaggcaacaccacccatcatcaactgagttaatgcccatccctaaatgtgtgtaacatgggcgaagtgaattttttctttctctgtcatgctcacttcccacttacctgctagagtaagagtatactagcatattatttagacatctagtttttaataatattcattttcatacaacatgaccacaaagaagaaactgttatatcttataatggaagaaaatctgactgtggagaagttactgagaaatggtacatctgcattatgctttatgggtgatttaaaggattttcaaatattattttgactacaggtaaaataactgtataatttatcatacaaatttgaaagcatttgagtcagacaggatattaatgataattaggctgaaatgacaggcataaatgaagagccttctggtaaattaaaatgtagtaccatcctaaatattatgggctgaactgtgtttccctcaaatttatatgttaaagttctaagtctctgatatggtttggctgtgtccccacccaaatctcaccttgaattgtaataatccccacatgtcgtaggaggaacctggtgggaggtaattgaatcatgggggatagattttcccatgctgttctattgatagtaactctcatgagatcagatggttttataaagagcagtttccctacacatgctccctcttgcctgctgccatataagacatgcctttggttttccttcaccttccaccatgattgtgaggcctccctagacatgcagaaccatgagtccattacacttatttttctttataaattacccagtcttgaatatgtctttaaatagcagtgtgagaacatactaatacagtttccatagtctccatacctcagaatatgactatattttggaatagggcatttaaagagatagttaaggtgaaatgagatcatgagggttggccctaatccaatatggttggtgtccttataagaaaaggaaattaggacacagacatgcacatgcacagaggtaagaccatttgaagacaatatgagattatgaccatctacaagccaaggacaaaggtcccagaagaactctaacctgcagacacctaaattttggacttccagcctccagaacatggagaaaattaatttcttttgtttaactcagccagtctgtggtattttttgatggcagctatagcaaactagcatactaatgatagtgattttcattttaaccatcagccttgaaactaatcacatcataagttgaggctctgccataacatcagttatgtcctgaggccatttggttgaataattgataaactgcttgaagcatgaccctacgaatagccctaaccatccatctcaaggcagagatattttatcttgttttattgcctaacagcactaaaaaaagaaaaaaatcttggttccattccaagatggccaaatagaaacagctccggtctgcagctcccagtgtgatcgatgcagaagatgggtgacttctgcatttccaactaaggtacctggttcatatcattgggactggttggacagtgggtgtagcccacggagggcaagccaaagcagggtgggacgtcgcctcacccaggaagtgcaaggggtcaggagatttccctttcctagccaaaggaagccatgatagactgtacctggaaaaatgggacactctcacccaaatactgcaattttcccacagtcttagcaactggcagaccaggagattctctcctgtgcctggctcagtgggtcccatgaccacgtagccttgctcactgctagcgcagcagtctgggattgccttgcaaggctgcagcctggcagggggagggatgttcaccattgctgaggcttgagcaggtaaacaaagcagccaggaagcctgaactgggcggagcccaccacagctcagcaaggcctgctgcctctatagattccacctctgtggacagggcatagctgaacaaaaggcagcagaaacttctacagacttaaacatccccgtctgacagctctgaagagagcagtggttctcccagcacagcatttgagctctgagaacagactgcctccttaagtgggtccctgatcccagtgtacccaaactgggagacacctcccagtaagggctgacagacacttcatacaggtgggtgcccctctgggatgaagcttccagaggaaggatcagacagcaacatttgctgttctgcaatattagctgttctgtagcctcctctggtgatacccaggcaaacagggtctgaagtggacctccagcaaactccaacagacctgcagctgagggatctgactgttagaaggaaaactaacaaacagaaaggaatagcatcaacatcaacaaaaaggacatccaaccaaaaccccatctgtaggtcaccaacatcaagaccaaaggtagataaaaccacaaagatggggagaaaccagagcagaaaagctgaaaactctaaaaaccagagcacctcttctcctccaaaggatcgcagctcctcacctgtaatggaacaatgctggatggaggatgactttgacgaattgacagaagtaggcttcagaaggtcagtaataacaaacttctctgagctaaaggagcatgttctaacccattgcaaggaaggtaaaaaccttgaaaaaaggttagatgaatggctaactagactaaacagtgtagagaagaccttaaatgatgtgatggagctgaacaccatggcccaagaacttcatgatgcatacacaagcttcaatagctgatttgatcaagtggaagaaaggatatcagtgattgaatatcaaattaatgaaataaagcaagaagacaagattagagaaaaataagtaaaaagaaatgaacaaagcctccaagaaatatgggattatgtgaaaagaccaaatctacatttgattggtgtacctgaaagtgacaaggagaatggaaacaagtgtgaaaacactcttcaggatattatccaggagaacttcctcaacctagcaaggtaggacaacattcaaattcaggaaatacagagaacaccacaaagatacgccttgagaagagcaaccccaagacacacaattatcagattcaccaaggttgaaatgaaggaaaaagtgttaagggcagccagaaagaaaggtcgggttacccacaaagggaagcccattagactaacagtggatctcttggcagaaaccctacaacccagaagatagtgggggccaatattcaatattcttaaagaaaacaattttcaacccagaatttcatatccatccaaactaagcttcataagtgtgggagaaacaaaattctttacagacaagcaaatgctgagagattttgtcaccaccaggcctgccctacaagacctcctgaaggaagcaataaacagggaaaggaacaactggtaccagccactgcaaaaacatgccaaattgtaaagaccatcgatgctatgaagaaactgcatcaattaaggggcaaaataaccagataacatcataatgacaggatcaaattcacacataacaatattaaccttaaatgtaaatgggctaaatgccccaattaaaagacatagactggtaaattggataaagagtcaaaatccatcagtgtgctgtattcaggagacccatctcacctgcagagacacacataggcttaaaataaagggatggaggaagacctaccaagcaaatagaaagcaaaaaaagcatgggttgtaatcctagtctctgataaaataggctttaaaccaacaaagatcgaaagagacaaagaaggccattaaataatggtaaagagatcaattcaacaagaagtgctaactatcctaaagatatatgcacccaatacaggagcaccaagattcttaaagcaagtccttagagacctgcaaagagacttagattcccccacagtaataatgggagactttaacaccccactgtcaacattagacagatcaacaagacagaagattaacaaggatatccaggacttgaactcagctctgcaccaagtggacctaatagacatctacagaactctccacctgaaatcaacagaatatacattcttctcagcaccacatcacacttattccaaaattgaccacatagttgcaagtaaagcactcctcagcaaatgtaaaagaacagaaatcataacaaactgtctctcagattacagtgcaatcaaatgagaactcaggattaagaaactcactcaaaatcactcaactacatggaaactgaacaacctgctcctgaatgacgactactgggtaaataacaaaatgaaggcagaaataaatatgttctttgaaaccaatgagaacaaagacacaatgtaccagattctctggaacacatttaaagcagtgtgtagagggaaatttatagcactaaatgcccacaagagaaagcaggaaaggtctaaaattgacaacctaacatcacaattaaaataactagagaagcaagagcaaacaaattcaaaagctagcagaaggcaagaaataactaagatgagagcagaactgaaggaaatagagacacaaaaaacccttcaaaacatcagtgaatccaggagctagttttttgaaaagaccaaacaaaattgataaaacgctagcaagactaataagaagaaaagagagaagaatcaaatagacgcaataaaaaatgataaaggggatatcaccaccgatcccacagaaatacaaaataccatcagagaatactataaacacctctatgcaaataaactagaaaatctagaagaaatggataaattcctggacacaaacaccctcccaagactaaaccaggaagaagttgaatctctgaatagatcaataacaggctctgaaattgaggcaacaattaatagcctaccaaccaagaaaaagtctaggaccagatggattcacagccgaaatctaccagggtacaaagaggagctggtaccattctttctgaaactattccaatcaagagtaaaagaagaaatcttccctaactcattttaggaggccagcatcatcctgatcccaaaacatggcagagacacaacaaaaaaagagagttttagaccaatatccctcatgaacatcgatgcaaaaatcctcaataaaatactggcaaaccgaatccagcagcacatcaaaaagcttatccaccatgatcaagtgggcttcatcgctgggatgcatgactggttcaacatacgcaaatcaataaacgtaatccatcacataaacagaaccaacgacaaaaaccacgattatttcaatagatgcagaaaaggcctttgacaaaaatcaacagccttcgacaaaattcaacagcccttcatgctaaaaactctcaaaaaagtaaatactgatggaacatatctcaaaatattaagagctatttatgacaaacccacagcaaatatcatactgaatgggcaaaaactggaagcatttcctttgaaaaccagcataagacaaggatgccctctctcaccattcctattcaacacagtattggaagttgtggccagggcaatcaggcaagagaaagaaagggtattcaattaggaaaagaggaagtcaaattgtccctgtttgcagatgcacgattgcatatttagaaaaccccatcgtctcagcccaaaatctccttaagctgataagcaacttcagtaaaatctcaagatacaaaatcagtgcgcaaaaatcacaggcattcttatacatcaataacagacaaacacagagccaaatcatgagtgaactcccattcacaattgcttcaaagagaataaaatacctgggaatccagcttgcaagggatgtgaaggacctcttcaagaagaactacaaatcactgctcaatgaaataaaagaggacacaaacaaatggaggaacattccatatttgtggataggaagaatcaatatcgtgaaaatggccatactgcccaaggtcatttatagattcaatgccatccccatcaagctaccaatgactttcttcacagaattggaaaaaactactttaaagttcacagggaaccaaaaaagagcccgcatagccaagataatcgtaagccaaaagaacaaagctggaggcatcacgctacctgacttcaaactatactacaaggctatagtaacaaaaacagcatggtactggtaccaaaacagatatatagaccaatggaacagaacagagcccacagaaataacaccacacatctacaatctatgatctttgacaaatcttacaaaaagtataaatgggtaaaggattctctatttaataaatggtgctgggaaaactggctagccacatgtagaaagctgaaactggatcccttccttacaacttatagaaaaattaattcaagatggattgaagacttaaattttggacctaaaaccataaaaaccctagaagaaaacttaggcaataccattcaggacataggcttgggcaaagacttcatgactaaaacaccaaaagcaatggcaacaaaagccaaaattgacaaatgggatctaattaaactaaagagcttctgcacagaaaaagaaactaccatcagagtgaagaggcaacctatggaatgggagaaaatttttgcaatctacccatctgacaaatggctaatatccagaatttacaaagagaacttaaacaaatttacaagaaaaagtcaaacaaccccatcaaaaagtgggcaaaggatatgaacagacacttctcaaaagaagacatttatacagccaacagacacatgaaaaaatgctcatcatcactggtcatcagacaaatgcaaatcaaaaccaaaatgagataccatctcataccaattagaatggtgatcattgaaaggtcaggaaacaacagatgctggagaggatgtggagaaataggaacacttttacattgttggtgggagtttaaattagttcaaccattgtgaaagacagtgtggtgattcctcaaggataaagaactagaaataccatttgacccagccatcctattactgggtatatacccaaaggattataaattatgctactatgaagacacatgcacatgtatgtttattgtggcactattcacaatagcaaaaacttggaactaacccaaatgtccatcaatgatagactggattaataaaatgtggcacatatacaccatggaatactatgcagccataaaaaaggatgagttcacatcctttgtagggacgtggatgaagctggaaaccatctttctcagcaaattatcacaaggacagaaaatcaaacaccgcctgttctcactcataggtgggaattaaacaatgacaacacttggacacagggaagagaacatcacacagcggggcctgtcaggtggtggggggctggtggagggatagcattaggagaaatacctaatgtaaatgacgagttgatgtgtgcagcaaaccactgtggcacatgcatacatatgtaacaaacctgcacattgtgtacatgtaccctagaacttaaagtataataataataaaaaaaatcctaaacaaaaataaaaagtgattcgggtcctgtctctgacacttgttaagcacatgcttagttgtgcataatcaaatagatcctccgaaccttatttgattcatgattaccacagagcaatatttggtctacttgactcagagagttattacatagctcaaacaagaccaaaacagtgatatgcaaactgcaaagcagttgagattgttaattttatgcatcagcttgactgagccatagggtgaccagattgaacattatttctggatgtgtctgtgagagtgtttctgaatgagatgagatttgaacagtgtgaaaggaaaataaatcttggggcccccaaatcactaagctaaagggaaaagtcaagctgggaactgcttagggcaagcatacctctctttctattcaaagtcatccctctgctcactgagataaatgcatatctgattgcctcctttggaaaggctcatcagaaactcaaacaaatgcaataatttgtctcttatctacctatgacctggaagacccttccccttcaagttgtcctacctttgcttcgagttatcctgcctttccagaccaaaccagtgttcatcttatatatgttgattaatgtctcatgtctccccacaatgtataaaaccaagctgtgcttcgaccaccttgggcacatgtcattaggacctcctgaggctgtgtcatggctgtgtgtccttaatttcggcaaaataaacttcctaagacctgtcttagattttggggtttacaataggtatacccagtaaagtaaatggctcttcccaatttgagtggggttcatccaattcactgaaggcctgagtggaacaaaaggtaaagaaatacatctccttttattttctacttcactgcttgagctgggaaatttcttctcatcttctcctgccctctgctcccctggttctctggcctgaagacttagattaaattacaccattggcatcctagactctctagcttgcagatagcagattgtggaacttcttagcctacataatcatgtgagccagtttctcattttatgtatgattatataaatgatgatgtatgatatgtatatattatattctctagagaatcctaatacagtggcccatgctatcaggcatcataaaccgaatgagagtaagaaaggccataagtatttgtaaattttacaggataattatcacactgtaaacactgtaccctggttctctttttggatattaaaaataaatcaggaaaatatataaaataacactgaaaatgttcaagactgtttaaggtagttccattctcttaaactcatctttgaaacaagactctaataaatgtttcctatggtgagtttcttgtcttgacttttaactatgtcatcagctcatgatgcagttgtaaccacacagtgaaatagtgttcttggcaatcaaattggtcctgaggtcaaacatttcttggagagtattatgaagaaataagatgaatgaatcaattctattgtgcatttattgcaattcatataagatgaagaaatataatgtagaaaattggtcactgaattaccagccactaacatggtattataaaggaaatgagatttaaatctgagaaggggattgtgtgcaagaacaagaatttgcaaatagttgacattagatccatctactcattcattcattcataaattcattcaaaaataggtactgagctctactgtgcgtgtaactcctgtctcaaaatttaaactgttgtttcagaatttagaattaagagatatctaatctcttactgattgatagacatgaccttgtacttatttgattctggtagaaaatgctaataaaaataatcaagaattattaggaatcattgactatccttatttgaacaacaaaaataattttgataaattatccattatattctatttgtgaatgtattagaaaattaaaatcatttaataataaattttgtttgtatcttacctaattccaaaccaacagcgacaaaaaacaagaatataaagaggcttgcttatctattgaagtaaaagtaattcagaactcttaaaaagaatgttgattttggtctttagtttcttgaagtcttctttttgaagaagtgacatgctgtggggaaaacctcttttatatttaattgtcttttttgtccaggaagtattcctagccagtgtgtcattatcttttaaaagtatgagaatacaatgaaaattaatgggtttctttaaactaacaatgaaccttcttcatgtaccttatcatattcttcaaacagcctctaatggaaaaagaagattgtgtttctaaaaattccccacagtgcaccaccacttcttttatatgttaaaaaaattcaaattaatgttattcataaaaacgtaggtgaaacagcctaaaaatagacccaactttttacattgaaattatcagtccttgcctaaacggtcatgtttagacaacaggacaattattttcaaattctctcaagtaagaggccaggtgtcaatattccccagaattatttgcaagtttcaagtccacaaatccatttaattttgctttaaatcagcatccgctgctacaccctggcaacccagaggtgtaaactggctcaaatatgtgtttttcttgttctgaacatttatcatcattatcgtcatcatcatcatcatcatcatttaatttaaatgctttaagcagtcctctattttccagtttcttattctgaaattactcattactgacttattcttagataatctagacatgtagaaggtactcaagcttagggttaaagacaagcactggagtcagttgtcttggttggtgaccttaccttataacttgttagctgattgactcattttttgattcttcagattctccatctataaaatgatgataataacagtccctatttcatcataatgaaatcataatgattacatgcaatactacctgcaattacctcaggaaatggcacttagaaaatcctcaagaaatgttagtcattgttcttatctgccccctgacaatatttgtatcagcaatctctgctacagtggactttgctaaaagaaagacattatctagcacacagttaatactaaaaaaaaaattactcttattagtgtctggcttctaaaaggatttgttgacttgcaaatcctgctaaagtttactttgtttagataactaggtacaattaggaacaagtggttctctagctgtgcctagagaactagttacaatttttaagctgtctggaatcttaaatcctaaagtctctcagattgttttttttttcattctcctttttttttcccatagcaactaaatcaattccaagaatcacaaagagaaaaaagaatgacaaaccgagggttgtaatcctagaaaatttataaagtaacataacagcatacagcatacatattctacgttgcacttatcataaccctaaagagttcatatttgtaactaaaattagcaggaatttatactgtccttcaggagtaaaggcagctgtgagctccaaattcttccttctcttttcaaaactcctctataacccgtcacaccgtcagagaataaactcacttagcaaaaccccaaagaagtgcctgcctaaccacttgcaaattagatacctgctggggtaagcaagacagtacccatgcaagaatgaagaggagaggggagaaggctgggatatgctctgataaaatgcacaattcgaggaaatagtctaactgcacactcagctcctgttgtctagggaagacaaagaaatatgtaaaattcaagctgacatactatgaacagtttcataatgaagctatatcacttattagaaaattatgcagatgaaccctgtattatggcagagggagccgcagaatagccaagaagctggctccacatggagacagacctcatggtcacgaaagcagtgaaccttgtctcctgacccagaacttgccattctgccaactgctgttcataaaattgaaataataaggaagaaccactaaaaatcattaattttgcaaaactagtggtattagaaaaggtatgagctttggagtctaagacatgtgatttgaattatgtttcttccagttctagctaggtaatcttgggtagaatacattatatctgaacctcagttatagctggaaaacaagattatgaataccttcctcttggggttgagataaagattgaattaaaaaaactccccttcccaaagtaaaacacgttcagtctttgtcctcccctgcacaaatgaactcattgtctcaggagtacagccaggtagacagtcacatccttctgtggaagtgatacagacatcctcactgcatgtgaaatggaagaaatattcttgtatattgtttaactgaaggatgaaattaaagttagaaatgcagactaggtagcccttatcccgccgtttatatgcatccttcctgtctacagaacacaactcagggagcaaataggagaactacaatggagtgataagaaaaaattgtcattcttgcatctgttatttagccatatctccagctcacccattttattatagttaataacgatggtaatcattcactgagataaagtactaagtactttatacatggaatctcactgaattctcatagttgcttttggagatgagttctttctttatctcctttttgcaaatgagaaaacagagcctcagagaggtttagaaacttgtttaagatcatacagtagctactgaagttgaagtcatgatttgaatgcttgtctgattctacattctctcttcttgtccttgtgtttccatccctctggcctttgactgccacagccctgtggctctccttcattgaactacctagttaggtatacctctcaagatctagctgtgatcccttctcttggacatcacttcaggcttgtttctggctccaaatctctatgaatatagataagagatacactcaaaacctttacctagcctcacaggggtttatccttgtagcatagacatatcttcatgacaaagtgaaccaggagtgtttgaaggcctgctttgtaaccaactgcatcaacattagggaaatcaccaggtgctttcatcattttcttctgtaaaataaaaatttataatgtgcttacaaactacatagctctttgggaagtaggcaaattgaatttttcaaattctcagtggcaagctgggcagtaaaacataattactgatttttaatatgtactttgtggcccttgtaattcaaagatgatgattttgactatcatcactatcagtgtgaaacaacaggagctcaaagagaatccaaagcttgatatcattcctgccctcattttagtgttgaaataaaagttcttaaggatttgaagaacatacttaggagttctctccatagcattttcatagcactcaaggaagtataaggattagctacagtgatcccaaatgctaataacatgaattttccaaatcagaaagtaaatactcagggcatagaaagagctctcgagtaccactgtgagccccaagatatctgataaagcatgagtgtttgggttttggtggctggaaggatggaatggagctaagcttataggttaaaagttacttatctttattctaagaaaatgtgagcctcataagttatctctgccttgatgatccctcttttacaattctcattgttaacacttaatttctgtaacattagcttacaaggattgtttctcaagtggaatttctgcctccaaacataataggcttacaacaaccatattattttcttttttgaaaattcctaaattcatttacgcatttgctcttacacctatcaatgcatccaaaccatatatttattgagcagatatttattgaaagcctgttcagtgctaggtacagggagtttaaaactgaatggcatggtttctgccaagaggaatatattagaaatttatagaaggcagaatactattatataacatcatcagagctataacagtagtgcagataaattgttttgagaaaacaaatttgggcagaagaaattgtttcccatgcataggaaacaataaacatgtgttggatgaaaaaaagaacatgtaatccaccggttaaagatggaaggacctcagttaggatagtatctcatgataatttttttttctttttacaatatagcacttattttaatgatacgaattgatgaatgaataaataaatgacaagtcaatgcacctatattatggaacagtagatatcagaaaaagctaaaggaaatttcaagagccatataatcaaatagattataaggacacacaaaccaaattaactgtagtgaaagataacatgagacaagaacaatgagaaataaataacaaatatgggtgatttcatagtatgaagagtactatttgttagaggcaactatcttagaagaaaaagtacatgagttggacttcgatggttggggtcctttgcataaagtcagaaaaggacattgcaagtgaatataaagataggaaagcaagggaaagaagatgaggaattatggtattcgttcaatcttgcagaaatgcaggatggaatggaaaactggaaaagccaagtttatatcaaaggagaaaggagttttctcctaagggtttgaaatctatggtgggtaaaagggagatattaaagtatttggggataaagactaacatgattatctctaaaatccaaatatgcaattatgtgttaaatactaacttcattttccagattatattgaaatcatcaaaggccagtgcggtggttcatgcctgtaatcccagcactttgggaggccgaggtgggcggatcacttgaggtcaagagttcaagaccagcctggtcaatatgatggaaccccatctttactaaaaatacaaagattagctgggcatggtggtgtgcacctgtaatcccagctactctggaggctgagacatgagaatcccttgaacctgaagggtgcagtgagccaagatcacaccactgcactccagcctggataacagagtgagactgtctcaaaaaataaataaataaataaataaataaataaataaataaataaataaaaaataaagaaagaaaagaaaaagaaaaaaaaatacttcaaatctttcctgtacctaaaacagttgtatttttccatcatatttacatgtgatttatttgaagccatctgcagtttgtttcttattctattttgttttctcacccaatagctatttattctgttcccgttgttgttattaaccttggcagcaaaaatttatctacaacaccttcagaatagaaaatatacagattagcaataatttgaagcctgagatcaggatgatatgtttttgtccattaaggaaatgttcatattccagttttaagcagctcatatctgtctaccaaactcaagaatacttacattctgaaatatctgaaattacaagtgttaattttttatgcagattgttctgctattctgttttctcatgcttaccactcaggctgagctcaaactatgaataagtgattaactggtgtgaactatgtggccatggtgatgttcagaatggtatgcttgatgatcctatcatagatagtgttttgatataagcattagatttaaggcttaggaattgcacttttcacacatatgtttaaacgtagtgacaatttctcctaatgttaaaatgcattctctgataaataaggcttgaacgctaccggtgaatatgtggagctcagtcagctatctcagctgctgcaaagatatagctattacatggttggtttgacagacaaggagctatcctctttaaaaaaataaaaaaaacatactccagcctacaacccgcagaggatgctgcatgcaacgcagtgattatgaatcctaccaaattttcagccatgccagcaattgcctcttcctcatatggaaatctttgcagccctgtcttcagaagaaaaacaaaggcagaggaaaaacaaaaaggaaattcctgtggtaagagagctcaagattcttgctctggcacttaaaagaacaaagccagtaattgccagagtagaacagacagagcactaacgatgggactgcaaaaagtacttgggctagctagctcaagaaggtgaaagacaggttacacatgctagcccttgagctaggagaaacagctattatcctaaagctgaggagaacccaatttagctgtaagactagggatgagggaaaaaaacacaacaacaataaatcctatctctatagtacctggtctttacccagttagaaagcagtagaatgaggaacagagagaaatagagaaacagagacagggagagagaaacaaagagagagagaggggagggagggagagaggtagttccagtttattatgtcaattatgcactaaaaatggggttgtcatggtctaaatgtatttcctaaaacttatatgttgaagtttaatcaccaatgtgttagtattaagagctgaggcatttaggaggtgattaactcatgaggacagagcctcatgagatcagggtctttaaaaaggcttgagggagtgattggctctcttctgccctcctgccatgtgaggacacagcgtttcccttctgatgcagcactcaaggtgccattttaaaagtggagagaacagcccttatcagacactgaatctgctggcatcttattcttggactcccagcatctagaactgtgagaacatagcttcctattgtttacaaattacccagtctcaggttttttttgttgtagcagcatgaatagactaagacaaaatcttactttaccttttgaccaaattaacatgcatggactgggaaagtagatacataacctgttttcttgtatctgatttgtcttacttctacctttttgcacccacttgattcttttctatcttgttgtatgctgcttcctttatttgcctatcttagtgttattttcttcattagggtctgagccaagcactgtcctgtatgctggagactctacctaactggacatacttattgcctttcaagagcttgaaaggaagatcaaaaccaaggctgggtcaggatatttattcttagcaagtcatacattttatattgagaagaattttataatttgaagtatgttcatcattccagtggaattttgataagaatttcacccaacccatgcaactgtgtcaaacagaaaaatcctgatggaaaatcatggctccatgggggagtttgctctggtggaaatacatctgtgtaggagttcctgttaaaagaagacacatcactacattttacctgtcagggattttttttaagtctacatatgcaaaggcaaagttgtcactagcgtgtaaacacagaatctctgggaaggatttgcaatatgacatctttccatgtctgctgtatttgattcgagatagcaaaaatgcaagtggttccccagagactacctatacaggcaggtttggagctagtgtttgtatcttgcagggattgtgaaataaagcgtacccatgtttaactctcaacacctcttgccaggctgagacaaaatggtgaaacaaggtggtcagcctggagttgtgaaaagagggtgggatttggattcagcaagatgtgagtttgaattccagctctatcacttttagttggggagtctctacaatacactttgattagggtagtgatacctactgagttgcagtgattaatggaaacactgcataaaataatcttattagaatgactagaatttaagaagctgttacacacacacacacacacacaataaatatgacgttagtttgacaatactgactacactacacataaaaataaagttcaaatctgtggtttaaggttattcttatgacattaagaccatttgtgatttagaaaatcgtatctaatacacgtgcttatgtaagggagacatacactccccccaaaatagctaaaatgtatggaacacataatatgtgccaggtcctgttcaaaaaaatttacatgcatgattctcaaccatttatactaaatccaattattagtccaatattatcttcactctgcagctttggtaactaaggcccagtaaggttgggtaatttgcccaaggttacacaaatactaagtgatgtagccaaatagatgtaggcagtctggttctagagcctgtgaagttacttatcgtaccatactacctagattttccctaaaaagtcaacaattattcttagagcagaggggagcctcatatagtatcaatttaattaagaaatatcaccctttccttgaggagttttaagttgaataaaaaataatggatataattctagttactgtgtggttaattgctaacacattgcagcacaacctatgtatgttctggattatacaggtgaaagaataacagggcaaaatttggaatggccaagaacagtcttcattcatctgtccttctatccatccataaatccattcatccactaatccatccatccattcatttgtcaatccatccatccatccatctacctatcctttctgattgcagtaaagggatgcagagcaaaatcttacagttaggtagacctaaattctagctcctgttttatcacttactagctgaatggtcttgagaaattaaggtaacctgattgagtctcctaaaatggaaaaataattaaaatatacttaatggtagtgttatgagaattacgtttatagacttctaggcacagtatctggtacaaaattaacactaaataaatgatggttatcaatattaacattaaagcttttatgtcaggtaccaaattacagttatgttctgaagatataaagattaataagatatatttcttgccctctaaaagattccagaagtttagtagggactttacacaagtgtgataaatgtggaatggttagttctaccatcgtttagggataagggaatcaagaatactaatagtagttggctgggcatggtggctcactcctgtaatcccagcattctggggggccaaagtgggagggtctcaggaacccaggaggttgagactgcagtgagccatgattgtacctttacactccagcctgggtgccagagtgagaccctgtctctaaaaatttttttaaaagaagaatgtaatttgttgagattttctgatgttcagatgctgagctaagtagttgtagcacttacttactatctcatttaattccaatgagaactattattacctctattttacaaaagaggaaagtgaggcttaaagaaatgcagtttgttgtttggagtcatgcatttaagaaagggaagggccgagaccttaacccaaataattttttttttttttttttttttagacggagtcttgctcagtcacccaggctggagttcagtggcaccatctctgctcactgcaagctctgtctctgcctcccgggttcacaccattctcctgcctcagcctcccgagtagctgggactacaggcacctgccaccatgcctggctaattttttgtatttttattagagacggggtttcaccgtgttagccaggatggtctcgacctcctgacctcgtgatcctcccacctcggcctcccgaagtgctgggattacaggcttgagccactgcacccggccaacccaagttattcttaatgtggaaaaactaagaagactgcctctaagctacattttaaaagattaccacccatttttaagtagatagatattgaggtgtattaaagacacaggaagcagtaaggaaagtgacaaaaataaatcaaactatgtggcccagttagaaaatatgaggtgattcagtgttcattcaaaaattgtttattgagggtccattacatgtcagggatctttcctaggtactgaaggtgcatggctgtaaaacatagactaaaattcctgccaacgtggaccttattatccattctctgggagggagacacccaaagtaaaattaaaaacacatgattaagaagttcattataaagtaatatatacaacatataataaagtataaaaacctatgttctaagtgctattgagaaaaaaaaagaagcagagaagacatcaaagtaggttgaaagtagggagattttctggttttaaatggatagtcagggaaggcttagccaagaagatgatatgcggacatataagctctgaagcgctgagagtgagccatttgggatatctagcagaaaagcttgccaggtacaggaggtagcatttgcaaagacccaggaaggaaaaatgactggcatgttggaggaacagacaggaggtcatggattgaaatatatatatatatatatatatatatatatatatatatatatatatatatacacacacacacacacacacacacacacacacgtgtgtgtgtgtgtgtgtgtattagcagaacatagaaaaagaaactagcaatgcaagagaggaaaaggagaattctagagccaaatctttgagcagtggaaggggtagggatctagctcacaaatatggttgatgtatgaaacttgtgcatgtctggtgggggtaggggtgaaggtgggagtgtttgaggtcaaatagggcaattcagccagagattaaattagaggtgtataggaaccaaatcttgaaggctcttccattacaggcatagatgtttggactttgtgctagtaaaaatgaggatctttaagggttttaggtacaggaatgaaatattccaataagtttcaccaggaaagtgaaacttctgctgagctttgaggcatttatgggatttgaatacatgagaggtaaaagaaagaacaatgtaggcaagaaggtcaacagtaataatgacccagaattggaatagttttggcagatggggaaccagttgaagatgtgtgctggcagacacctctgggggaaagaaaggaaaatatgagttatatctaaaaggctctggaatcaatctgcttaccaggtgcacactctatcacatactatctctgtgagcttgagcatgatccctaatttcttgctatctaatcacttgatataataaagataataatagtaatttcctcataaagaaaatgaaattaaatcatatggataaaatattacctgtatgcctgacacacattgttctcactaaatgttagttgttattctatatagcatcttgggaacctggagaggatgtaagagattggttccagatgtatggaatgtactagaaagaaacatgattgaaagcactatgatttcaggaggctgattatattatgtaaatctaaatattgatctctaatattcaaattcatcattttaaaggtcaaggcttataacagaattcatctagactaaccctggagataatataagaatcaaaatagctcttaaagttcaacagttaagcagttgagctgtggaaataggatatttatgagtagcttacacacacacacacacaaacacatatatattgtaaataaacacaatggggatctccatactgctaccaaattttcatattttataagccacaatgtgctagaaacaaaatttggtgcttcagaagaatgtttgattaatgatcatttctttgtaattagttatttgaatggacagcaacatcaacatatggaagaattcagaaaaaaagaacacagcatcgtacttcaggagtctttacattttctagaaggccaaattataaatagagtcttatctcacctatcatgagagcagattgctacttatgtatccatttataatttatctgaaaattccattttttaaagtttctgtatattcaatgtatcaaactggatagagagttcttttttcaagttttccagtttggtgaatagatagatagatagatagatagatagatagatagatagttagatagacagacagacagatacagatatagatatagatgtgtatatatatgtgtgtatgtgtgtgtatacaacatattgcttttccttgttaaatagcttgttaaattcagttctgtttcatgcgttaaagattacagcaggtaggtttctaaaaagtcatcatagattctacactgtttgggaatacatagctaatatctgcaactaaggtgaacgtgagaaaaatcacttatttggttttgcaactacagatctaactctcaagcattaagatatttcgtcaaattgatgttgaaaggtatctagcaaattcatgaaatctcatcctttaatccaaaattactacaaggaatatgaactaaaaaagccaaaagaggctatcacataataattagatactagatcaggcagtttttgtgttcagttctcaaaatactgaatatctcaaaatagtgaggagtgaatacaagagtgttaatcaagttcacaagtaaaattttattcccaatttgacaggtaggtgggtaaatatgaaacttagctgtgcctcatatggttgtgttgataggatttaatttaagtgactggatgcctactagattattgggcagaaaatataatttaaacataatttggccattaattagtcttaatggattggataaaatggctcagtgaacagattaaaaaaaattttctaatggtaaataatcctgtaagaatatctttagcctgagcaacacagcaagaccttgtctctacaaaaaatgtaaaaaattatctggctgtggtggtgtgcacttgtagtcctagctacttgggaggctgaggcaggagaatcacttgagcctgggagttgagggttgcagtgagttatcatcatgccacttcatgccagcctgggtaatacataatctgtctcaacaaaagaatatccttaaaatacaaagataaaatataaaaaaaattttagtgagattttagaaagtagagagatagagtagacaatttaatacaactttcaactaaaaaggtctgagagacttacagaagtttgtgttgtagaaatctagtgtttggttttctcagcagatattttcttttcttttggtaatagcagttggggtttcctttgggaaccgattccatttcatattgtcatgttatttgatatcaataagaagagccaaaaaatttaaggccaaactacaaaggttcatggccaggttctggcccagtgtaatgatcaacaagtcatataatcttcataaaggttgggtttctcattttcattttatcttgtttatttatttatttatttattttgtgatggagtttcactcttgttgctcatgctggagtgcaatggcatgatttctgttcactgcaacctctgcctcccaggttcaagcaattctcatgcctcagcctcccgagtaactgggattacaggtgctcctccatacccagcaaattttttgtatttttagtagagatggggtttcaccatattggccaggctggtctcaaactcctggcctcaagtgattcacccacctcggcctcccaaggtattgggattacaggtgtgagccaccacacccagcctagggtttctcatttttagaatagaagcaacattagcactatgttagtaaaatgccaccacaaatactttgcagaattactgtaacaattgcaatagagaaaggattgctacatcgatattaagaacacctagggggtgcttgctagtgtaaaccaacatgactaaccacaataggtgagtgtattagttcattttcaccctgctgataaagacatacccaagactggctaatttacaaggaaaaagaggtgtaaaggactcacagttccatgtggctggggaggcctcacaaacatggcggaaggtgaaaggcaaaaggcacaacttacatggcagcaggcaagagagagaatgagagccaagaaaaaggggtttccccttataaaaccatcagatctagtgagacatattcactaccatgagaacagtatgcgggaaaccatacccatgattcagttatcttccaccaggtccctcccacaatacatgggaattatgggagctacaattcaagagatttgggtggggacatagctaaatcatatcagtgagcttcattacaagttttaaaaaatgaaggcaacaacaggtgaactgtatggtatgggcatgataacttaatagagtgttttaaaatatgatggcagtttattttcatcaatggttggtcttttcattatcaacatgagaataacaaatgtatcttatataaaatgaaggatcaggttgatgtctacttgacattccccatgaactacactggtattagggagacattagatactcccagatatactggctttggcttcctgggaatggagtgtagcttggtgacagctgggcagagagcctcaggcatgctccccattcctgtgcagagggcacagccatggaaagcatttcttggacttatttataccatcagtaccctaatgacagaagaaatacagcttatttcatattcatttttaaaagtaaccttaaacatcaggaacacaaaagaagtggtagagaattcggaggtaataggggaacaaaaagcatttagtgtgataatttagagggtgtgtgcaaacttcatgcagatttaaatttcccaacagcttgcaaataggttactcaagtattcaaaagcagaaatttctagaggtgcattagtcgtaaaggccatggaatgtagccttttatgtttattgttttcatttacattctgtccaaccctgagtcttgtagtctaaaagggtgtgacatgtgtgttcaattgcatccaagaatgtcttctgaaactgagtccctccactgtagaataaaaacagcctgggttcaaatagcagactcacttcccagtaaagctggcccattgacttgggccatttacttgtattttctgagcctcagtttcttcatctgtaaactgaggggctaataatgtacttacactatagtggtaaagataacatgggaaaatatatgtcaaatgcataggtccaggggtatagtgcatttgattaagagcacaacaaataattacaattatcattgttaccctttttgtgaatttttttctttttttttttttgagacagagtctcgctctgtcacccaggctggagtgcagtggtgcgatctctgctcactgcaagctccgcctcccaggttcaccctgttgtcttgcctcagcctcccgagtagctgggactacaggcgcctgccaccacgcccagctaattttttttgtatttttagtagaggcggggtttcaccgtgttaccaggatggtcttgatctcctgacctcgtgattggcccgcctcagcctcccaaagtgctgggattacaggcgtgagccaccgtgcctggcctggccattgttaccctttttgatacagttgtgaggagtgaaaaatactcacgttcaaaaaggtacctttcaaggcagagtctccctcctaagagataaggaatttcagaaacacaccaggaatcaaggtggatagagagtttctcacctcctgaaaattacagtctaaacttttgacttcttttaccccagagtatcttaagtttgggaggaaatgtttgtgttttctctaaaagaaaagcacagaaatatcttctgcctaaattattattatacaacttgttttttcttcttttgaaacctctgtggcagataaaacttgtatgttaaaaaggaatttaaaaagataacacttgcaaaattttgtgaaacctaatataatcttctccaaagtgtaacgcattagttttccttaaagtagaaatggtttccatttactcccttcaagataaaactaagaatcttaggatggtatgcaagttcttccatgatctggatccgagatttggatgctagcatgatgccataaagcattgccagccccgtaagcctatttgtagtttcttaaacatagccagatctttcagtaatccatgttttttcatttacagtattcttccttctgaacattcattcttccccagtcattcaagttagctagttactgcctatccttcaaaattcatcacaagtatatgctttttaaggaggtgtgttctaaatgtctccatctcccacatctgttaaattactggctcttaatctgtttaaagcatcccttcagacctgtatcatgaagtttattatcagtgttacgtttgcctttttgctggtctccacaactcatttgttcatgacttgagaataacgggtcttcatatcccaagaccaggcacacaggggactcagtaattggtcctgtttagacttgcggattgcacccaatacaaaaccatgataagcaatgttaaatgccacagcagtgccagagaatcagttaataaatgcatatgacagattattatatccatagcagaagaggttattttaagaactactgcttgttttgtgtctgagtaaagatggaatatcaaacataatttctttacgatcaaacgaagcttatttccagataggaaggcattttttttccttttttctttattttcagtaaggaattaaattagaaaaatcatttgcatttttacatttgtcttctctgaatatgcagggctggttgaattctgtctgacaccttcacagaactcgcttaagtaagctttccattactaaataaattgcatccattctaattaaagatatgtagagcatactactcggacaggagaagcaaagtgctatgaagagctagagcttccatggtaaccctgctagggataatataattgattcaaatggtctctcctgccacatactgattccatgccaacaagccttgaaaactgtccatcatttcacagagctagttatagaccaagtccagctaagacaaataaatggtgatagaacttccagagacaattactacaatgaatcatgaaagacactccttgctttctagctcatttagtgattgattaccatcaacaaggtttaaataattatgtagtgaatatatgagtaatttacagaaagaaagggaaatacgtgtatcaattctttttgtataggggatctgctgtgggagaaataactcaaaactcaaatggtataggcaccacattaggcttaatattggtacatcattctgcctcattgctggttgtttgcgtccaagcttgtcaggcaatgtgtgagaatattatgcacacataataggaagtgataaagccccatgaaaatgaagattcagaaagtgagaaaagcacagtactttttcattccccttacaacatattatagttcctctggtcctaaccagagtgagatagagaaatgagttgatttctgtaaaccaaacttctcaactctagtagctcatattcctgacattcgctttggttgctgaatttgtcagcagcactcgaggttgatcaggtggtgtttcactggaagattggtatttgtgcgtagtggtggtggtggcgggtacttgctatttaggatgccatttgcactaaaccaatttcatcaatatcctggttagactaacttgttcattcacttcactccaggtatttcccacactttaaatttgctcccgcattgctatctaggttacacttaatagcctgctgatttagaagccagtctctcagtcaatcatcaagttatcaggcaattcgtttagattaaacctagtggaatactcacattgagctctttcagcttatatttgcttttgaaaatcttgagatttcaagctttcatatatttcactgcctctttaacaaaatgttagcactatcttttaatatacttttttcaatatgtattggtacctaaagccataataaattcctttaataaaaatgcgccaatagattcattttcttcttttttgctgcacaatattatctcatagtgtcagtgatggaaatctgctctctatttttagagggtgggatgaagtaaagaaggcttataagttggctctaaattctagaagctgaaatccaaggatcattccaaaagtcggcaggtgatttcctatctttgttcttgttttgctctgaaagaattcctctcttaaatactaacctgttgaactactaccatacatttaaatactacctaaaactttctaccttttcccttccaattgcatttgatcatgccatgttctcaaccttcacagaattttaaaacagtttccagctatcccttaacacaagggatatttatgtgtgcatttatatattcaagtgatcatagaaatttagtcttttataaatctctatatacttttctatttttgtttaaattaaaatatagaaaggaaatagagcaagacacctttatacatactacgtagctatctacatatttattaacaatctttcaaattaaaaaaacacagggttgaaatcatatattcttttcttcttcagaccaagtccctccttcttcctattctgtccaacaggttaaaaacaatcgttaattcattatgcattatccttacaatccatttttgaaatagacacatattatctatgcatgagcaatatatcatactgtgagatttttttcttaatttacataaattctactctagtgtattattatgttacatcttatttttggtgttctacattaattttgagatttctgttatttcatattaacctagttaattgctttaacctgctgaatagtatctccttgtatgaatctttcactattttgaatactgttagctctaccttcaaaatatattcaaaatccaactacttctcaccacttccaggctaccactctgaattatcctgtcttgtttggattattgaacagtcttctaccgttctgcatgcttcctcttcagagaccttaaatctattctcaaaacagtcagagtgactcttttaaaaggtatgtcatattatgccactaacctatttgaaatcctcacgtggctttgcctctctttcactcaacacttccaacaatgctgcatttaagttttactactaggtgggagagtttctctaagatgaatgcctgtaaatgaaattctctctctttcatattattttcccaagtgattatagaaagatttatagtcacagcagtgacatataaactgttcttttaaagccttcatagaaccctagcacatagctttgtagacaatagatggcaaataattatttaaatccttcatccttcaagaaacagttcctgtattagccacccgccataactgtttttctatatctctttcagaaagattcatgcttggccttcctgtatagaaattttgtaagtgctttcatttttgcatcttcatgcttcttattgtaattatgtatgtctgctccccacctgcccacccccatcacccacttccccaccatattagtgctcgttctctggaactgggtcttcattgcaccctagtatctaagaagaaaatgagtatattcaaattggagatgatctactaccaagaacagaggaattttcttacatatgtaatccccttttcatatcaccatagttgctattggtgattgacagatattgctatttttttccattttatagatgacaaaattgagggctattattttcccattgataaagaagtaggaaaaggcagaatgtacattgtaaaaacgctacactaaaacctaagcatattttactcttgtctgggacatagaaagtgctttgtatacccttttactaaaaaacttcctaagataatactatgtaaatattgccatatttgattagccaatgtaagattttatttactttgatcatattcttaagtaaaaacagcctcaacaactggaaaaaaatacaattttcctgtcttttacccataggttgtgagtgtgtctctctgtgtgtggcagggtgggggtctgggggatgatgagggagagggagggagagggagagggggagagagagagagagagggagagagagagggagagagagagatcctatattgtgcttctagttttaaggtcaagtatagatcactcttaatttgagggatttttgacagttattgatggtttgactttcaagaataaatcaatgaaatgctgagaaacaaaaagcaccttaaagcttacttcgacaaagtggccatgaatgaagaaaatgagacattgttaatctgaagccataatcatatttttggctatagattaactacttactactcaccatattggacagacctactttgttcctatacaaccctcaaaactgattttcctccatgttccaatacctttccccactactcacagatacactatatttccattggtgacacacacacacacacacacgaattggcttgaaaaatagcccatttgttttcacaacaaagggagaggcacctgataagattgttgcaaggtatatgttctcagcacagcaccattagctctaggatgcaagccccagtgtgcttgcctctttgcttttttcatctgaagagtcaaagctcttgtttattgctactgaaaggcagctgtgggtgaaatcagcagtgtcattgtccaaagattctggcaatgggtttaagtaaacaactaagggatgttctgtgccttcgttaataactaaatgtcggtgtgagagaagggacgagatgtcatttcttccagttaccccactggctttattgaaaactcagttttgaacaatgattctctgccttttcactgtcacccaattaagcttgaagcttttattttaccttttcaagatctctatacctctccaggaggaacaggacacaatagagggttttcacagcattgcaggcagatagtagatttgtaatgattagcaatgacacattctattttgggactagatttatcattcatatgctttcattctccaggtagtatttttactcaacttttaaaaatacttggcattcttggctcattcatgtacatagaaaagatatgtagcattactcccacccaaatcctttcaagttatgttgaatgttgtcactgaaatcatgtgtcatgtgtaacagagctcaaccactgagctgacaattcctgcagatgagttaaagtttgaattcactatattgatttattcttagttttaaaagccaacttgggcttcatatcttgccaaagattacctatttataatcattataaccatgtcagtgggtgcaatggaattgggtcttctcagccattttggaattaccaaggaataaattaatgtttctacgactcccagctttattttctgtcaacagctattcattgaggaggagtaagtattaaattgtgagacgccctggagatacagcagtgagcgcaaagagacccagtaactcccacatatcaccaatggtctagcatggagtcatatattagtcaaacacatgcatatttaagtaaatcattgaaagtatcaacaggctgcaaaagagacaggagctacaggagcctaagaaaatggaacagcaaatgttgaggaaaggggaaacatttcaaaaagttatcctaagtaaatgttgtatgaccttgggatgtatgcaggatgtgggaatggatggacgaacagattttccaacagagataacagcacatgctgaaatatgtagtacttggaataagaacaggacagagaaaactctgccatggacagaggtcattgaaagagacagtatggcaggccatgagcccagtgaggtaaacaggaacattcaggacatcacaggccatgttaaagactatggcttttattctaagggcaatggaagatatagatgggctttaagcaggacagtgatctgaccaggtttatgttaaaagaagaatcactcatattaaaattgaggatagtcatatcttgcattgacaatatcaaaggagcagtataatgatccaagaggaccaataagttcaaagtaaaaagataaattccaagcatccagtagagttaataggtgcactctcagggtataattgtagctataagagtatctgcttcaatctattattcaaaaacatacatcaatgctcaaattttacaattcttcacttaaaatggagcaccaatagatgatcccaagatttagtaacatctacacctgcagtagcctttaaatctggttaataaagatgcctattgccacttaattgttttatctactgcacagcaagctgaacccatggctcaaatctgaattatccatgaaacaaaataccagaaactataaatgaagtattaccacacatcctttgatataaccattattaaaaccttaaagataaaatttattagcacatatttattgagtgcccacaatgttccagatactgtgtatacaacagtgattaccaccatttgaattgtgtctcccaaaattcatatgttgaagtcctaactgccagtacctcagaatatgactgcatttggagacagagcatttaaagaggtagttaagttaaaatgatgccattagggtgggctctaatccaatgtgacttgtgcctattgtcagaagaagaaatctggacacataaagaaacacctgggatgtacacacacagagaaaagatcaagactcagcaagaagtcggccatctgcaagccaaggagtgaggtacccaaagaaaccaaccctgctgacaccttgatcttggacatgcagcctccagaactgtgatcaataaatttctggtgtttatgccacacagtctgtgatagtttgttatggcagccctagaaaggaatacatttagcaagttataaatctttttttttttctaacagtttacgatctggtggggaacagagataaaggtgcaaaaagagagagaatagcttctttgataaggggaatataaggtgctatgggacacctacccttaatttcggggtcagaaaatgatcactggagaaatgtatctctatgttgaagtctatgtaggagtagcaagacaaaaaaaaaaaaaaaaaagagggtggaagagttttagaaaaagaatgcatgcaattactcatgcaaaaacccataagacaggatgacagtgtgaggatctggatactttgcatggaggggatcactaagtgagtatttgctgattttttaaatagatttatctattacattgtggttaaaataccttccgattttacctggatttatgcaaatgcctattcattggttttcctgcttccattctctgtccctactacgctgtatcaccacaacacccagagggttcattaaaaaatctgaattacatctagtcactgtccttaagtaggcttgggggcttcctacagcactaccaaataagcaaatacatagataaataagcaactaaatatattaataaataacctcttacctgcaaagtttgatatgatctagctcatgcctacctctcatacctactttaattctactctctgacccaccctacctcaccccatccccagccacatgggcttcttgcagggccacaagagcacgccgagctcagtcctacctcacagccttgtacttgttcttccctctatccagaatacactttcaccaggtttttgcatgtctatctccttatctcatcacctcctcagaaagtctctaactcacctgtctaaatactccttccctccactcctctatggaattatgtattgtatcaccatcatttattttttatgttaaatagcatttatcctatattaaaacatattaagggcttttttctcctatcatctctctttctacccaaactaaaatttaaactctatgggagtagaagtctcatctgattgtatattgcaaatcaaagtgactggaacacagtagatattaaataagtatgtgttgaatgagtaatattaaaccatccaagttgactctgattgtaaattcatataatctatcctaaacatgaaacagggaacaatgggaagattttgaaccattcctagaaagtagagacaaatgtaatcccatggtacaaaaaaggcagcattaaaactacctcccagattgatgtggaataacttgtagcatgttaagcctgtgcctgtaagaacacattgaacatttaccgtgtgctcacatatcacagtgaatcagaaaggacagaattgatccagagaatttgccccagagaatttgccaactggtattgtcatttgattctgagtaagatgcttaaccatataaagtgtactgtaaattatggatgacaacactggccacatctacatcacatagagatagtttgggaggtaatgagatttttacttgaaatagctgagctccctggggagaaggcagaaaggggagatgaaataaattgcagccaaataccattaactctatatatttacaacataatttacactgatatactaagctatcgtgtcattaagaggggcgctttgtctcttttctgcagattgcctcccttattgatctccatttatttatcttctacactttatggaacagggtttcctggggctttgtcaatacagactttcagggttgacagacagtactagaagcaactgggtagaggatagtactgccacaaaggcacatctagcccaaagggtaatggcattcagagttttggaggcatagatttagatgaaagtgttgcttaaaattggagtgagagaggtgaccaatattgttctggttaaagggtgttcatggccaaactctatttaccagactatgagagcaaatgctgggtgatttaagtaggagtcaagacagaaccaccagcaggaggtgggataaatgttaacagagaatgctccacacaagactctaaggctctacaaagggttctgggcctagcagaaaataagaatacaaagatgaagagtatatagtacaatggttaggactgtgggctcccataccggaatgcctgtatttgaatcctctgtctcttccacttcctaagttaagggacctcaagcaattgacttttcttctttaaaaagaagattcaatttcttaatctccataagcgatcagtgctaaaacatatagaatgattgcgaatagcaaaaggattcacatatttaaaacatctagataggattcagccacataaggaatagtaaattttgtttttcattgtcattgtcatcaccatcatatcccttatcaaggtactagattgtggccgtgaagcttagaccgagagattagatggggcaggtgctgatggagccaaccagaaacatttcaaaccaggtgccacagatttaactgtggaatatcagatacaaaagtctattggacaaatgagtgtgtcccaagtgccactaaattatggaacctagttttccaataattttgctgaccaagtcaaaactagctcaaacaagtgattgagtagatacaactttgggagaactgggacaaaccatgggaacttgatgatctaacggtcatcaatcaaggaaaaaatatcacacttgtctctttcaaaggctatattttagtctgtaatgggtcgtataaatatggggaaattactttttagtagcagataatgtagaaacaataaagaaattaactaacttttcagaaccttgtggtttgtatgcaattgcatttttcattatgttcttgtatccttgctctttcttaaggcggaattacctttcctcttagacaataaagagaaattgaacaactgctgagacaatcattttctttactaaatagacatgaagttcctcaaatagtatataagagagatgatctttgttttactgtttatggtgccagtcatctggcctctaaattgacctgcaagcagggctatactttgaccactgtttatattccaaccagatgcaagtggagttatgaaagactgtcataaaaaaaaagaactcaggaaaatgctctccatattctctgtatctcctgttggcaaaacacataatttcccctgttgtgatacaccttaatcaaaattctcaatgcatttgttaattcataaaatatttctgaggattactattagtcacacatgtgtttggcaacaccaaggctgcaatgaacaaggaacatttagtcccagccttacaaaatcctactttctagcagattcagtataaacagataactaaggaacatgtacattttcattcctcaggtgagggaggggacacgactaacatttttagagtgtttatggtgccagacaccacgctggacactctatagatctttggaggggcagcttatctttttgcaggtatactcagtcaactacatcaccactgtagctgcctatctagcctcaaaatcttcaaggaaataagtccacaaagcttgaaaggaacaggacatccagaaagctctacacatactatccttcctcctgcacagtgtaaactttgaattctcattttagtagctaacccaccagagagcgataacttcattttgctatgggctacaggaggtgaagatagaaactgcattttggaggcaatggcctgaaggtaggttatttccatgcctagacttagaacatgttatctttaaacagagcaggcaggagaaggaaaggaaggaatatcaattgatgccattgccttcacaaatccttgatgaactgctcagtagggactaaataattggtaatagctattgtgtttattgtgtatagctaaaccagaaatgagtgttcatggaaatgtcattctataaccaagaaaaaaataaggaacaatgatcagtttgacattttaaacaagaggcatattttcatttggttcaataagaaaagtttctaagcaacgtttaattatattttacaccagatttcaggtgtgcttaattgcagtattaacttctttaccaaggtctcctaaaatacacttggttactattctgagaatgtcttcagtctctcttcatgaaacttggtgagacaacaaacaaatgatatgtcatcaaaattaacttgttaaagggaacaagaattaaaattataccttaaaaacttttccatttctgaaaagaaaaacaacgcacactattaaattcctggctcagaaggtgaaccaatatgaatcctttcttgaatctaatcaatcattttggcttgcttgggactataaggttttgtggacagtggagtttcagtgttaaaatggcagggttcccagaaaaccagaatgagttagtcaccttcctctcttcatagatttgtcgtgataattaaataaaataatgtctatcaaaggcatatcataaaatactttgtactcacaagcattgcgaaatgtcagccattgtcaaagtacttactatgacaggtgtggtgctaagcagttagttttacaagagacctttctgctcctgaatatctcagcttgcataatggacgtcagggacagctcagagaggggaatgagtggagagcaatagatatccttttctctgggacgggatgaaaggcatttacatacaaaattgcaatagtagggacagctagagagggctgctttgagcctgagaataggctcctgagaaagatttcaggtgtgctgaaagatttcaggtgtgctgaaagaaagaatgagggaagctagtgaattatctatagctgagtaaattataacggattaccatcactaaaatatatttattttatagtctaaaagcaaatgttatattttacatatatatgtaaccatatataataaatatatatgtaataataaatatatataattttaaaaagcctcaactgttccacactaactatacctctgaatctgaattttctaggctgtatatgacataagaagtgtccctatttcataatgaggctttcttcaatgagtaagtgagataatttatgtctatcacttttcatgttttaagtactcaatatacccatagattattatctttttatctttttataacagttttattggggtataatcaacatatcatataatttaacctgttaaagtgaattatattgagtgaattcaatagtgttcagtacatgcacagttgtgcaacagtcaccacaattaattttagaagatctttgccctccaaaacatccttctatccttttagctattaccctccacttttccccaacactccaggcctaggcaaccactctagagaattgcctatcctggatatttcatgtatatttcatttaattaaaattaaacaatatgtagtcttttgtgactggcttcattcatttagcataatatgatgacccatgttgtatcagtaaatcatttctttttattgctgaataatatttcattgtatacatgtaatatctttatttataacttgatagacatttgggttgttttcatcttttgagtattataaataatactgtcatgaacattcatgtgcaagctttatgttgacatatattgtcttgttttttttttttctttgagacagaatctcactctgttacaccagctgaagttcagtggcacaatcaaggctcattgcagccttgacctccctgggctcaggtgatcctcccaccgcaacttccttagaagctgggactataggtgtgtgccaccatacctaactaattttttttatagagataggggtttcaccgtgttgcccaggcagttctgaaagtcctgggctcaagcaatccatctgcctcagtctcccaaagtgccgggattacaagtgtgagccactgcacccagcacacagacatatattctcatctctatttttttttaaattatactttaagttctagggtacatgtgcacaatgtgcaggtttgttacatatgtatacatgtgccatattggtgtgctgcacccattaacttgtcatttacattaggtatatctcctaatgatatccctcccccctccccccaccccacaacaggccccagtgtgtgatgttcctcttcctgtgtccaagtgttcttattgttcaattcccacctatgagtgagaacatgcggtgtttggtttttgtcctggcgatagtttgctgagaatgatggtttccagcttcatccatgtccctacaaaggccatgaactcatccttttttatggctgcatagtattccatggtgtatatgtgccacattttcttaatccagtttatcattgatggacatttgcgttggttccaagtcttttctattgcgaatagtgccacaataaacatacgtgtgcatgtgtctttatagcagcataatttataatcctttgggcatatacccagtaataggatggctgggtcaaatggtatttctagttttagatccttgaggaatcgccacactgtcttccacaatgattgaactagtttacagtccccccaacagtgtaaaagtgtttctatttctccacatcctctccagcacctgttgtttcctgactttttaatgattgcccttctaactactgtgagatggtatctcattgtggttttgatttgcatttctctgatggccagtgatgatgagcatttttttgtgtgtctgttggctgcataaatatcttcttttgagaagtgtctgttcatatcctttgcccaatttttgatggggttgtttgtttttttcttgtaaatttgttggagttctttgtagattctggatattagccctttgtcagataagtagattgtaaaaattgtctcccattctataggttgcctgttcactctgacggtggtttcttttgctgtgcagaagctctttagtttacttagatcccaattgtcaattttggcttttgttgccattgcttttggtgttttagacatgaagtccttgcccatgcctatgtcttcaatggtattgcctaggttttcttctagggtttttatggttttaagtctaacatttaagtctttagtccatcttgaattaatttttgtataaggtgtaaggaagggatccagtttcagctttctccatatggctagccagttttcccagcaccatttattaaatagggaatcctttccccatttcttgtttttgtcaggtttgtgaaagatcagatggttgtacatgtgtggtattatttctgagggctttgttctgttccattggtctatatatctgttttggtaccagtaccatgctgttttggttactatagccttgtagtatagtttgaagtcaagtagtgtgatgcctccagctttgttcttttggcttaggattgtcttggcaatgcgggcccttttttggttccatatgaacataccttgtgtatatttttgggagtgaaactgctgggtaatacagtaatgctatgtttaattttttgaggaactgtcagatatttttccaaagtaaatgcatcattttacattcctgccaacagtgcatgaaggttctaatttctccatatacttgccaacatttgttattatcattgttttttattatagccatcctagtgtgtgtgaagtggtatgtcaatgtggtttttattttcattttcttgacagcagatcatgttgagcatcttttcatgtgcttattggcatttttatatcttccttggataaacctctattgaaatcctttgcccttttcaaattgggttgatataaaatactattaagtaatttctatacttagtcagtacttaaagagtacctactatgttccaaatactttataattataatcactaacatgtaaaaagtaatccttcaaaatagtattgtaatttccatttagtttatgttgggacactcaagatcagcataaaaaggaaaaacttactaagctaacagaggcagatacaggattaggactaatgttcagctaacatggaaacccaaaaagctcagtaattttttgatgctaggtggccacctgagcacactgaagtaaatgaactcatcctctcttctgataccttctgtgatcctccaaattttatcaggaacgtgccctaaatgcacatctttgatgctcccctaacgtggagaataaaattcacactcctcagcatgccactgagacctacccatacttgatatgctccaccatcccagcctcacttgacgccattccctaaccctgtacatcactcagctggaaaaccacaagtttcccagtgtcctacaggaaatttgcacttttctgtctcctggaaaaattctactgattctacgggcagctcaaaagtcttcatcagctgtgctaaattcttcttgtcccctgcaatcacattcctttccctcttcagcacacatactgttccttaattcaaccagtactgctgtgtaagtgtgatgttcctgatgtgtacaaagtaatggaggcataatagtggacatagtccggtccctgacactaggaagctgaaagtctagccagagtctgtttccactgctatcctgtaaactgtctgagcccagggatagtatcattaacttttatcacctcaccagcaagcacattccctggtaaaatctagattacaaaaaaggtatttctgatattttactgagactaccaacactcatacatcttgcaggagatagactcttctgctaatgacaataaatggaagggaactctggcaataaactgctgagaactgcacagcagcacttcccagctatctgccatatgagaattagaacaaaacaatgcaacccaaatgggaaggtggaagtgcacaatgaatacacaaagctataaactaagtgataatttttgtcttgattgtgtgagctaactattaagaagattataattaagagttcatttcttatagtaccaacaagcattttaatcaaccttgatagcattagctccaattaccattagtaaactataaagattctgttttaaattgcaatgagtcaataaattcaagatggcactttaggagtaaatgttaacaggaccttgtcattttcctgagcactcacaagctatggatgggggcttcgtgaaggcacaagcaacagtgggatttacgaagcgctgtgagcttcacaaacgctgtttgtactctggtgtgaaacgaaaaataattacccttaagaatgtttgataactgtttgatctatgaatttttagcttcatagctttaaagaaagacattttatttagccaaacaatctaatagactaacaaactcaaaacaaaggctgacaaagagagtcatctgaaattctcattattaacttacaacatttgcataaatttgaacagagatggatggctttaaatgacggtcactaattaagagaccgaaacaaacaaaagactaacaaaacattatgtacaaagacaagcacattagcatattctatctcatatctcccttaaaatgacatgaagacaaatattcctgattacacctgaagcaataatgtaactaaggcaataaatcacttgaagaaacctaagggggcttctttttaaacacattgatttgggtattaggactgtcactgaaatataaacataaaatggaatcaaatttgttgtgatgatgtatcactgaaacgtttgcctctttcctggaaaaatttaatcagtaggtggacatgtgactataacccagatgtatttgtttaaaaagactgccagattattagaaaactctctttcaaatgtccatcagaatagacatttatccctagtaaggcacatcacaggattgaaagtcaagtcaaaagtggttaaatgcttgggtgttgcatttttttgcttcccttaagagaagatctagaagtttttttttcaatgaatttaactctaaagtcttatttttaagatgtgtaacaaagttcacattgtgtgggaaaatttgacagtagggaagcaaagaaaggatagaacactgggcagagtctagctataactatgcaggggtggcaccacccattttcagaaaggccaccacaaagagacatggcaagaaagaaagtcccttgttggatgagccacgggaaatctgtgatgcaaggatttcagtatctcagacctgatatccattagcaccttggtacgcaaaacaaatttgttttacagactaatggtaataactgacataaaccctgaaaatttcaagttatttagaaatgaatttttttcaatcaaaattttgttctaacttttccaactattagaatcacactatgatgttatctgttagaatgttttgtaattttcttctctaatgtgattatccagttctccactgccatcattgaaatttcccaccaattctatgtataaaacattttacatttaggtaaacttaaaagacaccttagtagagtgttgataaacactccaataattaatcttgtaaatacccagaatatgcagaatctgtataaaaaatttatggtccagataccctgatcaaatgtctggataattcattcatttaccaagtgttggttcaatccctacttgcctactgcgtgaagtgttattcttagggaagttacttattttccttaaaatcaacatctacttttttgttaatctactgtgcagtctttagagaaaaaattatgaacctatagaatgtttcagattctttcaacaaatttaagaaaagagaataacactgcatggttccataataacaatttcagtactaccatcatttgcataaaggcaatgtctcttttactatataagaaggaaaaatatatctaaaaattcagtgctccttcagaggccacagtatctactatcctggcaatctttacagttttctcacttcttcgggggacagtctaccctctacttcttcagcatctccctatccctgatagacacaacctcagagtagttaagtgacccagaactgaccaatcagaagtttctgcattcctggtttcagtgattaattcaaaaactaaacatatttaaaaatcaatcatggccagtcaattttcactgggattactcatatggaacccagtataaatatgctgtcttatcctgcaatgttgctaacctgggaatgtagggctcctgtgttccccatgctacttttaaaaagctaactgtcataggctcgaacaagagcaatatacactgggaaactgagaaatacatgatggaacactgatagaaagacagtcctactctcactgagttctagttctgttctccagatgcctgctccctatagatcatcctttgacttgaactacccacaatgtgcttcctagtaatatatgtcaataaacttcacttttaattcagggtgtacattttcaccctgtaactgaaaaagtcttgattgacacttctcctttaatgatgttgaataaattagctctcatgctttggcattcttttattacatttccatttattgaacattgactgggctcacaaagcactgggctcacaagcactgggctcacaaagactaagccacaatccttatatttaataattaaataacatttaattatttgataatctttatattgaatatagaaaacttaacacgtgtggggacccactcagaaccccagagttggtatgaagattatttgatgctgaagaaatttgaaattcgacaaatgcagaaagaaatcttcttaaaacttctctcatctgagcagaagcagaaatttgtgagaaataaggcttccataaatccctttagggcaggtctactcccagaagagaaaccaagggtaaactaccacagattccctcttgggagagtttctaggccaagaaagagtggaaaaggccactcctacctccatacacaaacattattatcatacatcttttaatcttctgtctgttttcctaaaaatctatttgtctttcctaaataaaccatctgttcttcctatagaagccttttctcccccacccctttcctttagtaacttaggtatataggcctctaaccttagtcacctagctagcttgctagttcatttattagttctcctattcatgggaataagccttttttccccctttaatccatattttgtcagtttagttcacagacctcagagagcaaacttaagagggtaccagaaaagttttcctccctgacacacataaaccattaacataataaaaatttgtatattttatttaaaaatgtatagtataaaaactgtatattgaggaaatgtcctatagagacaatcacatacacatatgtcatcatcatcatcatcattatcagcttcatcaaagggcttcttttaaatgatgtgggggtaaggtaatcttcaaaacaactataatggatcttgacaaaataatttcaaagttctgaatcacttatttggtttaaatgagatttattcatcacaaattctttgggtctcatctcatccaaattgatctcaaatagaaaacatgctttttattctgatcatttactttacgtaaagggctaacacatgtatacttccctttgcaggcagaccatgctgaatactatatatatacatatataagactatgtagagtctcctatatatagtctatatatacatatataagactatgtagagtctcctatatatagtctatatatacatatataagactatgtagagtctcctatatatagtctatatatacatatatagtccttctctagaaatacatacaaaatatcagttcagtcttccccaatatgactgaggtagtcattcttattatccccttcttaaaaatgaggatcctgggccgggtgtggtggctcacgcctgtaatcccagcactttgggagaccaaggtgggtggatcacctcaggtcaggagtttgagaccagcctggccaagatggtgaaactctgtctctactaaaaatacaaaaattagctgagcatggtggcagatgcctgtagtcccagctgctcaggaggctgaggcaggagagttgcctgaacccgggaggcggaggttgcagtgagctgagatctagccactgcactccagcctggtgacagagcaagactccaaaaaaaaaaaaaaaaaaagaggattctgatatttaaagtagagagataaactatcaaaagttagagagatagttcaggatggaactaggtcttgtcaaagtaaccaatatcctctgggtgggctcaaagttgtcactatgactcttacaagaaaacaacagcaagggggtcagagtcagagatgaagctggaatggtgaaagcagtgttggagtaatgagaagccatgaactgaaggctacggtcagacttcagaagctggaagaaggctagaaaacagattctctcttagagattccagaaggagcccagccttgctgacaccttgattttagcccagtgaaatgaattcaaatttctggtgtgcagaactgtaaaaaataagtgtgttattttaagctgctcagttggtggaaatttattatagctacaataggaaaccaacagaatctcacaacatcttttcccagtggggaaaataaaaagtaatatttacatggcatctgccttggcaactgggggtgttctttcagaacctatagctgaggcaaaaaaataaaaaataaaaagaagaattaagaagatagagtcacatattcaggcctcattagaaattaaatctgaagcaaaagcccttatacttgatatgctaagtattaataaaagttatatccaaatagcaaggtgacaaattctggaaaacctttcatctgactctgcaatatcaatttaaaacactccattgatgtttcaatattacaaaatgccctggaaacacctgggatgatggagacattggtattaatatttttttccatgaataatatcatcacatttatcaatagcatactaagagggagagcatcaagataaatagctaatgtatgcagggcttaacacctaggtgatgggttgataggtacagcaaaccaccacggcacacatttatctatgtaacaaacctccacattttgtacatgtatcctggaacttaaaattttttaaaaagcataccaaatcactgagtttttttacaggatccttcaaaacaagatattaaatatttactaatcagtgttaataaatattctaaatatttttaaatataacattgcttctgcctgatccaatgatctagagttaatgaatttgatgatgctatcaaaaagctaaatatggcaatagaccattgatcactcttgctatgaaagaatggggactataagtcaataaataagtgggggctcctgttttcaatagttcgctgcccttgagtatgccatttttccctaaaagggattgaagatgggtgatggactatatgattaaaattcataaaaatgacatgttattctaagatgactgggtacagaaaatctcgtcagctcttacttaagcaattttccaaaaactggaaggaaacacagtcacacacaccgtggggtcacttcctgcagagatgacttggggacatagctgaatgaggctgaaaagtcagacctcacaagttcattataggtttagctgaggctggggcctgtcggactcttttttgtttgtttgttttttggtcaaggttaagtctgggtaagtctattcaggtatgttttcccagaatttaagctaaaatgatgaaaactgcctttgaacttgaaggttctgcggtaagtgcacaaattaaaagacatctgaaggtaggaagaggagacgttgcctttcttcttaatttgaatgttcagaaaaaccagtaattagattcattacgttaaaattgaacttaattcctttaatctgaaaatttcaaagggctttcaaaagctcacaaattgctgttaatcccaatggcacaaagatgacctatgtcattttaatggtatggtatggttgaaataaaaacacaagagtttgattattcctctgagggttcagtttcgttttgctctcccataaattaatttgaagagaaaaatcaacttggtgtcagtgattaagcaataattttaatgcatacacatgcacatgtacgtttgcatacagagtgaaatttattctttaaatagctgtagagaatctacaaaagcagagtacaaactacccagagtgaatagttagtatcaataaaactcatattccatttttactgtggaccatacttctagcaccagcattttgatcccaaacacaaaaagcacactggaattcctctctctctttctttctttctcactttttctctctcgtaatctccttcttgctatcattcatagcgctagagaattttagactagaaaagacttaagaaatcacttatttactagttcttctttttatacctgtgtaaactgatcaatcaaattaaagcaagttgactgggtaaatggagttgctagttaggaaaataggaattaatgcctacaatgactactgtcatctctttcaaaatctgtttaaaaaataattacatagtttaggaacacatagtgtggcaaaagggttttctttttgtatttttccttttgtttctatcacatagcatccatctttccttctcacgttagcacctcaacctagattgtagggaactactgtcccaccacaagcccaggcccctccagggggcttccaggttgaggcatgtggctcagaagtctaaccactcagagcatggtgttgccttggccagggtgtaggttctgttagggcatgtggtccaaagagggccaatgaggcatgaggccgtttcttctgaagccactggccaggaggtagctgctcttccccactgagactgaccctcacaggatgtgatgcaggcattgtctgcaaccacctagcaccacgtgaagccagaaaataaagccattagagtagaagccagagctgagagattaaatggattcctaatgacatattaaattaagttccacctgaagcccagaactaccacctgggcctctcaattatttgggccaagaaattgtgggtttattttttgtttttgttgaagccagtttgaactggcttttaagtcactcaagtactaactgggcttgccagataaaatacaggaggcttggttaaatttgaatttcagataaacagtgaataactttttttttttttttgagatggagtctcacactgtcgaacaggctggagtgcagtggcacgatctcggttcaacccaacctccacctcacaggttcaagcaattctcctgcctcagcctcccaagtagcggtataaacatttcctatgcaatattaggaaaatctgacaattctaattctaatcatacagcaagctatttctagacgtggagcagggccagtagagaaaggagagagacccatgacaatagcacagagacaggtgctgtcataagaagtagtaaggtgttgtatatactttcctggagaggagaagagctagttagttattacagtgtcatagagaaaaggcaatatatttatcaagctggtgttccaaatccctttttcctgctctgatcccatctcttccttggattcaacctcaagtcctggaattcatccagtaaggaaagaggtagaaacagcctctatgtcaatcatgacccactatgagttcagtttaattcattgtattccattaggcatttgcagacattgtgcagaacattgcaggggagcgtgggtgaaaaggtcctaattgccctattctaagggctctaatatgtccagaggaacaaatataggcaaagacaacaagataactgtaatgcctgatggattagtatggatggtggggggaaaggccaactctgaaaaaggtgggagttgagctagaccttggtggagaggtatagtatgtggggtgggtgggagtggtcatttcaaacacacgtcctcttgccatttcctatttttctttctgttcctctcctctcctctcctctcctctcccctcccttcccctcccttcctcttctcttctcttctcttctcttctcttctcttctcttctcttctcttctcttctcttctcttcgttctttctttcttccttcttttctcctgcttttctagtaattatgatgttgtttatcaaattagcatcaagtgcaaatctattaatgggggtgtgaccaagcatccaactggtgctggattggttagggctcatgaatatataattaaaattctataagggttgcattcagcaaatatgtagaattttaaagctggaagagacctttagcaagcccctgattttgtaggtgagagaacgaatgtgagatcaggtaactggtgatagttgcagatctgggactagaaaccaatgaagttatgctcagcatggttgctcgtgcctgtaatcccagcactttgggaggccaaagtgggaggatcacttgaggtcaggagtttgtgaccagcctggccaacatggtgaaaccccgtctctactaaaaatacaaaaattagctgggcatggtggtgggggcccgtaatcctagctactcgggaggctgaggcaggagagtcgcttgaatccaggaggcagaggttacagtgagctgacatggtgccactgcactcagccaaaaaagaaatcaatgaggttgactctagaatccaagcttcctcacctactaaaggccattaaactagcaggctttatgtcctgattttgttctctattaaagagtaccagggggaaatatacagctgaagtttattttccattctccatcagtctagaataatctcatttggatatttctcaaataaggaaaaacatggactttctctttaaggaatgacgatttgtgaagactgtcccattttacaaatctccgatgcccatgtacaatgggaaacccaaggggctccccaaacacttccatttgtctttttctggggcagacctattaaggtgccactgttcagaaaactcagcagcaagttaatttgcccatgttgaatgtgagtctgctgaacttggggtaaattgatatttccctatttcagatataaatgtagcaagaaaaaaaatccctttcagattcttaaaacacttggactgatttgctgagaaaaagccagcaacagggaattaaggagcagagtatcccatctgcaatgagatgtacagtgtaaaatcaggttatcagtgaaaatgagtctgatgtgctaattcatagcacattccctatacttacgttgtgagcccattatataatttagcaagattctggggcctttctcaagggagggcaagttctagaaaacagaggttctaggcaagcatgaggaaagtcctttaatgaaggaagaagtcaggtctatattttccaaaagcccatgctatttatacctctagcccctgatgttttaatagtgaaagaatggtgctgattttgacttttccctgaagcacacactttcacatgcaaggaaatgaatctttagcatatcctggatgaaaaagcaagaaatgtcctattaacttgaatgaggcattaaagggtctttgatgcagttcaacttctaaaacgcatatactttctcctccaggttacttatggtagacacattcttaactcctttgaaatgcagaatgagaaaaaattatttgtcttcttcaaattcactggctagatggattctctgcatgtacttcaatttccccaaaccttagtgctatattttttaaggaagtggagttattcaaaaatgataatacactcatggttgcaaattcagatttcttcagtggaagcataaataactatttcttccgtgaatagaaaaatgagtccgtgtaatactttgtctcttcatattatcacagttgtggatattataccaaatggtaacacagaataggaatagctcatcctggacttctgttcatagagaaagacaaagcatttagctgctaacaggccttgtcaattccccaaggcttccttgtaggcgggaataactccattcttttgctggtttcctaacaatggtagttgtattcataggctaactctcttccttttgctcttgccctttactgctgtattctaaagttttcagctctgcaatgaaaccttcagcatgaaacatccacacaatcccaccaccaaatgtctcacctgtacctgcttacacagcttgctctctctggtcatagatgcacaaccaggatctgatcttaggcctactttttcactgttctctggatcccacctcctctgaatgatgtacctgctctcttcttcatcattattcttccctcttcactggattattagcatataagcattctataatacatcctattttttaaaaaaaacaaaagacttccatgggtcccctcatccctgtgtagactgagatgtcctatgttctttataattaagttcttttgctctggcatcccttcttaggcattcctgagcccacaagcccattccagtgagactgtggtctacaccactctattgtcatgatcaccaaagacttttactagcacttatcttattgaactgatcagcagcatttgggagttggtaactgtttcttccttgaaatgtcttcttcccctggatacagtaagatactcttgacaaagctttctgtctccagggtgtttcttctcagtctccattatttattaagtataagcttaaataactttacatcctggaaggccccaagggctgtccttaaatctctgttattgtccatatccacacccattgaaattatattggctatatttgaaatatatctagaacctataaccaatttccactgctatcatcctagtcaatgtcaccatcttctcacttccatacaattgaaataggctcctgagaagtggccttactgatggttttgccacctacagtctagtctttcccaagaggccagatctatcctttaaaaatacgtgccagatcttgtcagtcttccatttgacactgagtataacctcattcctccacttttcatctagaataaaatttaaaatttccacatgatccactctgcatcatctctataacctaatagaacgacttccgtgtccttcacctaataccttaatcaattcctgttgctatgaccaaataccacagactgcataatttataaataatagacaattatttctcacatttctagaggccaggaagtccaagatcaaggtgcaacagattcagtttctggtggggacccatgctctccttccaagagggtgccctgtttctcctctggaggggacaaatgctgtgtccacacatggaggaagaccagagaggcaaaaagggactaaggtgctctgttctgcttcttttatacgagcactaatcccatccatgagggtggagaactcatgacttaatcactctcccaaaggcctcacctcttaatactgccacaccagagattaggttccaaccttagaattttgaagacacacaggcattcaaaccgtagcccatactttccggtagccatgctggatttcttgctgttccttgaatgctccaagcacactcccacctgtggttcttgctctcacagtttcctctgcctgggggggctctcccagcagatatcagtagcttgcttctccaaataactcagatatcatccaatacatttgtcccttgcatcctcattactctctgttctcacccaccagcttcatttttcatagtacttactataacaaaaaatttcacttgtttattatttttttcctgcttcttttagaatacaagctccttgttagcaggaatttattttattctcttccattccctcaagtctagaacacttctagttccttagtaactgcttagtaaatatctatggttgaatgcatctccatctctgtgatataacctcatccatatctaccttccttactgccttatgatgcctctggatgtaatttagattttgagtattttttctattcccaagtattccaaacttacacacacacacaatatgagcttacacatacacatcatatttttataaacatgtacacgtatacatagcatattaacaatcttcaatgatttattcaacatctaatataaaaaagtattattatataggattgtagacaaattctaagaatgttaaagcaattaaaagctattatgttataaaccaaccaataagtaaattgtatacattattttagtgagaaaaaaattctggaatgatggttaaatattagtctgggacagatggcaactgcatatgatttgctacatatccaagaattaactggtaactacactatgacattagttctaggataactaaatcttttttaatagctttataattgacaaaaattctttgcttgaccaaactttagtcaggcttttgaatcttctcctaggcctatctgtgcacttccttgtaaaaaccagttttagcaagaaccttgatgtcagtttagaaggaacaccccactcacactctgggttcatctgatcatcccctcaatatctaatctcatcctccatcctctgacctctcccaggtctgatcaccctggcctgccttcagcaagacacttgttaggttggtttggccagaatcccgtctccctgaagttcttagtaattttccgtccactaacatgtcacctaaccctggctccttaaatctaaatccccactttctcatgccatgtttggagttgagctcagtctctctcccccactgcaaaaatctcattgctttggtagctatacccatcacaatggtcatgaataaaatcttccttattgtgcatccttattgtgtatcattgagtaattctgtctttaacataactaaacaaaaaaaaacctctgacagtttgtcctttaaactagaacctctcaaacacgtcagcaggtatttctttcctattattggagcccggtatatttggcaaggcagtgcttaaggtgataaggatgaagactgcagtctgtggattcccacagaagtgactatgtgccactttctagttcagcaacttgcttttcctctgtatgcttcctgagaagtcaaagaaataacatcttttaaacacccaggatcatgcatgacacatggaaggacctaataaatatcagccattatcattatcattgctatttctgttagtccaagtattagcttcaaatatgtaaactgcatatagtttgttggggcagtctgaggttgctctatctcatcatcagggggtctcagtccatcacagctagtggcctgtcatcttttattttatgttatttatttttgttttgagacagagttttgctctcgttgcccatgctagagcgcaatggcgcgatcttggctcactgcaaactccgcctcccgggttcaagcgattctcctgcctcagcctcttgagtagctgggattacaggcatgcaccaccaagcccggctaattttgtatttttagtagagacggggtttctccatgttggtcagggtggtctcgaactcctgacctcaggtgatccacccgcctcagcttcccaaagtgttaggattacaggcatgagccactgtacctggccccgtcatcttttaaactgtaaagacagaggggccttgctctgtagctgaaagtcaatgcttctcggcctcttgcagctaagtagataatgtgtggctgaggaaagggaaacttactgaacttttaaagactatttttggggaaaaatgtcaaactctttaaaagagaggcattaaaaccctctcctatctcttcctcctaatctaatagtgcaaaaggcataaataatagcatcaacaatataggaatattttctaactgctagcattgtagcagtggcatcaaacagcactagtaaccactgtgttcctcaccatcacccacgggcaaaaagcaaataggccagtttcaattagtaatatacataatgaagaaaattatgacttttattaaatcacaactcgagctcatctttataatattctttgtgacaaaatgggagagatacataagataatcccattgcctacataaatatgacaattatctcaaggaaaagcgctgatgtaattgagttttgtgctgaattagccatcttgttcaagagccaatatttttacttgagagagtaactggcaaactatagttattcagactcagatatttggcagcattttcttaaagatgagcaaagttagcctgtaccttcaaggaaacaattgagagtattcgtgaataatgatgaaatctgagctttcaggcaaaaattattttggaaaactcatatctgctaccaggggcttggcagttttgtgatacttcaagtctttactgacttttaggttgatggttattttaataaatactgatttttgatatcatagaacaaaaactttgataacacttggaaatgtatataacttagtgaatcaatattttccaacattatgcatagagaaaagatacattcaaagttcaacatagaccttaaatgatttttatgaccacaatgatatatggagtgacaaggatctcctctcatcttttctgtgtttactgccttctagcaagattggactcttaatttatattttgctttgttttatttagtatgcctcttggctctactcataaaattccctctgcctagagaactttcccccacagagagtcacatggcaggctcacctcattcaaatctctcaacaaatgcaccctccataaataaaccatccaggttagccctatccaaagtaacttccctctatatctttattcttcctcattttactcataattgctgggcatttcctaatacatttattaaatattgctagtcttttccaagggaacgtaagtgccatgaagtaggaaatttgtctctttttttcactgtgtgttccacagccttgaacagtgtctggagtaaattatgtactcaacagatgtttgttgagtgaatgaatcaatgaataaataaacattgtaagttctaatacactcagggtgagagcagctaaatatcttaagcaaactcacatagctttgttggctaagctagaattggtatcagtttagtgccagaacctaaactcttaactaatacactattgcacattttgaactccctaaaaatttacaagtatacattccctcatttccattgccactttttattttagtcagataatctaatttaattgagaaagtcctgctttttggtagacaagccgtccctctttcaattcatacagttaaggagaaaaagaataaaagttatagtcagttgtaaggaaacttcaaataattatacagatataggctatcaggaatgctgaaataaatttgctcatgcattgcaacattggccaaactgatcaatatccacaggctaaaaaaataaacaactgaatctctctaggccacagctgtctttctatggataatttacagagttagaaaatagctcaaaacacacaaaggctctatagaatcagaaaaccaaacgaagccggtagacattgaagacttccaatatttttggtccatttcaaaatcttgtgcaactttttatatgtatttttaaaccaaagggcaataagtgtcttctaggagcaacaaagttaagatttgtattatccagtaatatgataatatagaaatattgacattcagagccttcccaaattctttgtcacaattttatgccctccaaggaaaactcagtgtcaagtggttattgagggtagcctgttttgttaatcaggagaatgttcaaagagacaaatcgcaagaatgaatttagagcaacgtaaattataaagattctgcaaggaggcacagaggagaaagagaagccaaggaaatacaggctaaggattttgagagagagtttcagaaggagaaaaagagtagagtagtgacattagggacagctcctgtggtgtgaaggtttgaggagagaggtttcaggatgttttgctgtgtttcattgcaaagtaattgttttcagtgcaattgtttcaattcaatggtttcaatgcgatgcaatttaattaatcttttagactttttttgagaaatgttattaaagccaaattactttgctctgttatgtttagacttggaattatatttcttttagattcaacaaccaagttgtgggtcttgatcagaaggaagcctggtgtgattctcgttacagtgacttgctgaggaaatttcatcagtggagtctgatcagatatagtgttgacacaagctgtatttctttctactatttcacttttaagtaatacttttagtaaaggttagttcacaaaccagtgacatcccaaatctgtttctttcttctatgatcttgggtttcactgtcaaaaatggcaaccacaggccccatattgctattgggcactttaaatgtggccaatgagactgagaaacttaatttttatgttatttggtttatatttaaatttaaaaaaggaacacatttagttttaggaaatcttcaagtttttttttgttttttacttttttttttcttttttagagacagggtcttgctctgtcactcaatctggaatgcaatggcatgatcatagctcactgcaacctcgacctcctgggctcaagccatctccccacctcagcctcctgagtatctgggactacaggtgtgtgccaccgtatctggttaattaaaaaaaaaaaacttctattttggagaggcaggggtctcactatgtttcccaggttggtctcaaactcctggcctcaagtgatcctcccaaggcactggaattacaagcatgcacccagcctcaagtattattttgaatactatgtttgtggatccgcttttctgaactgtaaattttgtaaaatttcaataaagatcaagcatctgtgctgaaaatttaccatatgaattaaaataggtaaaaaaaatactgcaacatttataaacagtgcagaaaagaaaaaataatatgttattagaaatgttatattgaagacatgttgaaataatatactttggataattgagttatgaaatattttaatctaatattcattctgtcgtgcaacaaatgtttaatgagtgcttgctataaaatacatcgttaggaaaaaaggggtcgataaaattgtgctgaactgaatataataaggtaaaaataaatgtatgtgagtgtatgagtgatgggaactgaggggaccatgcatgacagagatatgagtcaacttttcatggggaatttgagattctagtttgcctgtcatcagtcctgagggttttgaatgccagaccaaagcgaagaggaagagtctctgtaaagccatggaagcagcatgaaaaacaatgagcatgagaagagtaggaagacctgcctggttgaatgggaacatattttgggaacgtgaaaagagcagaaaaataagcacaatttgtaccaattgcagttgatggcactccttctacgagagtacagtaaatacactgcagagtttaaaaagcctagaaagacatggaaaataatagtatacttactatattttgttcaaattaacaatgagacccatggctttgaattcaaaagtgttctacctaaagagatactggagactgtaaaaaaaagtatataaagcatattactagaaattgtgattaaagttgtagtgttttaaaatagttctgcaaattctttgacggtcttgccttgcacaggtgttgcttgcttcccctcccctggaatgtaggtcagacttaatgatctctttggaaccacagaatgtggcagaattagtattctatgacttgcaaggttatcaacgggatgtagcttctgcctggtttttattcctgcatcactgtctctgggggaagccagctttcatgttgtgaagacattcaagcaacactatggaaaaacccacatagtagaacggaggccgcctgctggaagccagtaccaccttgttagccatgtgagtgaaccatcgagtggatcagccagccacagttaagcctgtaggtggcagaagcttggaccaacaccttgactgcaacctcatcaacaacaccaagctagaacctcccagccaggccatttctgaattcctgacccatgtaaaactgtgtattataatcagtgcttattactttaatgagttatgtggtacttatttttgcagcaataaataactagtaaaagcatgttatttaaggagaaatttatcctatgttttctgacctttcagatatcctgtaggtacctgaagtggcaaatgttgggatgagggtactatcttggcaataatggtctggcaacattgacaaagggattggatggcccacagacagacaacactgaaaggtgacagggtctattttagtctttcaaggtagaggtgacctggagaaaggcaatggcagcagaaatagagaaataaaagagatgaagcctataaatgccaggaattattcattcaaagacgatatcacattttttgagctagagtgactaattggtgctgccttagagaaaaatttttaggtgcttaggaagagaggttcgattttagacagtgaaatttagggtaacagatgtcttgaggctggaaaaggggcaaagagtttgtgttgatgtaaactgaactttgatgtaattgtcaagaggctttcttgggaggggtttgttgatatttactaaaaatagcaggaaagcaaacttttagatagtgagggccattgatcaatatttggccagtgagttggtttgcttatgaaaccctggaatcaataatgatggaaaatctacccatgaacctttggctgatggttctcaacaatgttacagaaagtaaatgaagttctataccactgatattaacagaaacagtgaagaccaaagaaaatgtctttcctcagttcctgttaataaggagtcagagttggccaggcaaattggctcacacctgtaattccagcactgtaacagtccaagatgagtggatcgctggagcccaggagtttgagaccagcctggacaacatggcaaaactccatctgtccccaaaacaaataaacaaacaaacaacaacaaatacttagccaggcatatggaggaatgtgcctgtggtcttagctacttggggggccaaagtgggaggatcacttgagcccaggaggttgaggctgcagtgagccgtgaccatgccactacactccagcctgggtgacagagcaagatcccgtctcaaaaaaataaaagaagtcagaattatcttaccagtttttgttttctatttcattcacattaagtagttaaaatcttgccctctgttcattcattttcatcataaagctccttctagcatcctcatcaaaggaggaagaggaagagctacagtgtactgaaacaaattatccccacgtatggggcacttgacatactcaatttctcttagctctgaagtactctaccatgtaagaaagggatgcttaccctcactcacaaatcagaaaatgaagtgtaagagaaatgaattgtccagagcctggattggaaacactcaagcctctagtctaaccattttgtagctctttgacagctgcttatcatacacacaaccaacagtcattctcccctttgttcctgctcataccatgttcttacctaacctgctgcttgaaaacctgcgatcccattgcatctcatgaaaaagccctctgatcctttccatggattccacatggattccctttccaagctttctccacattcttccttctttcttgaagatttctgctacctcagttcctcacagaaattcatctgacctctaaattaagagttggtgacacatggcttggcagtgaagaactctggattagccatttattagtactttggttaattgacttgactgtcttctggaaaacagggagagaccataacttatgctgctgtgaatttcttcataccttgctgattactggcaatcaattgcttttatatgtgtatttgattttaaaagatccaaacttgaaattatgctcagaaccatctcatttgtttctatgatatgtagatgccttttaaatctgtctatagcctcatactgggttttatttccagaaactccaccagctttcttggttaacaaaattttccacaatggtgcatgtcttttatatttctatgttaattttatatggtgttctgctacttttaacatgacttttctccattattccctggaaaactgcatcctttaagattgtaggtcatgctgacattggtatacaagcattcctctatcccttttccattcatgtagctactctgtgtttagataggagtgaacatgacacattgcctcagggggagcttcactgctataagccagagaacactgatatatctccttgccccagggttatgtgcaggactggcaagtagcccatatatatgtcgattcactgatggcatttcctcgctacaataactggttacagaattggcaggggcctcaggtggtcaagttagactaaccatcatatttttatttggttgttagggggaggctatctcttgatgtagacaaagtggcattagggtaagtagatgtgagacgtggtactgacagaaccatttccaagctctgagctaagctaggctgaggttggaactgccacatggaaaaggccagactcaggaaattcatcgagaaatggccatggaactttgatccctagccctgaagtctgctttacctctgggtgtttttagctacatgaaccaataaatgcttttaattgcttaaacctaattgagttgagttttccattacttgtaactgaaagcaccttaaaaaaatccagataaaatttaactccctttgtaaagccctctcaaatctctacaggcaggtcagtttactgacccttcttttcttccccataactttgctcatacagcactcatcccattggaagtgttgcactgcaatgaactgttttataatctgtttttccagcacactatgagttcagtaagaacaggaactagatcccattcagcgtcacatccctagagtgttacacattgcccagttcttttaggaggcatcaataaaggaaggaatgaatcttcagctcctttaccctggttcttatttcagtccctgacaagaacccagatattcaacagctgaggaaagttagagtttacgtagtgtctgaactgttgtattgcagtctgcagcagttcaacctatttatcacagggttattagtctttcccccaaaccacttttaaccaagtcccattacactccaagtccttctgaaattacttacagcttctgcagaatagaccatttttatgtccattcatttatttactcagcaaatatttatcctgcgcctacctgtgtcagtcagtagtgtaaacacacaacattaacgaaaaaatcttggccttacattctagcagaggaagttataaacaaaatctataagtaaatatagagtaggttagatgatgatatgttctatgaaaaaaaaagcagcgaagtgaaacagaaagtactagaggtggttttattgcaattataggcagagaggtcaggacagtctcaatgagatggtgacaactaaagaaggtaatggagatgtatacatatcttagagaaaaaaagtattcagagagagtaaacataaagtgcaaagactaccagacatataaaacaatgtccatagtcattaatcgtcaggaaaatgcaaaacaaaatcacaatgacttatcacctcacatgtatcaggatggctattatgacagaaaacaaaagacaagtgttgacaaaggtgtggagaaattgaaaccctctcaggctcctgtggaaataccactgagagagcagttgctatgataaacattatggaagaaccaccaaaaattaaaactagaactaccatatgatacagcaattcacttctgggtatttatccaaaataattgaaataggatcttaaagacatattagcactcccatgttcattgcagcactattcacaatagccaagaggtgaaaacaatctaagtgtccatcaatagatgaataggtaaagaaaatgtggtacatacaatggaatattattgaatctttaaaatggagattctataatttgtgacaacctgaatgaatctttaattttttttcttttttgaatatttaatttttatgggcacatggtgtatatatttatggggaacatgagatattttgatacgggcatacaatgcaaaataattacaccagggtaaatggggtattcacctcctcaagcattcatcatttcttttttttatgatcattctaattgtactgtctcagttgttctaaaaggtaaaacaaattatcgctgactatagtcaccctgttgtgctatcaaatgctagatcttattcattctacctaactatatttttgtacccattaaccatccccattcccccccagtccccactacccttcccagcctctggtaatgataattctactctatttgaaggagtcttaggacattatataagtgaagaaatacagttacagaaagacaaatactgcatgattccacttatatgtgggtacctagagtaatcacattcatagaatcaaagagtggaatgaatggtggttgccaggggctggaggaaggagaaaatgaggagctactttctgtccatggacagaaagagtcagtaaaaatgaataagctttagagatctgttgtacaacattgtgcctttagtaaataatattgcacaactaaatattgcatatttaaaaaggtaagggacacattaggaggctgaggcaggcagatcaccttaggtcaggagttcgagaccagcctgaccaacatggcaaaaccccatctctactaaaattacaaaaaaaaaaaaaaattagccaggtgtggtggcgcacgcttgtaatcccaactattcaggaggctgaggcaagagaatcacttgaatccgggagacagaggttgtagtgagctgagagtgtgccattgcactccagcctgggtgacagagtgggactttgtctcaaacaagcaaacaaaccaaataaacaaataaaaaggtaagagagtagttctcattttaaatggtctcactacacacacacgtacaaacacaaatggacacaaaacaaagaccctggatggagcacctggtgtgggagaggaaaaaccaggctggagagaggctggagcagagtgaatgaagaggagatgggtgggaaagatatgggatgataatatcagagagataaagcaggtcagtaaaccactgaactcttccgacgtaggcattttaatcacggtaaaatgagaagcttctgtaaagatttcacagacaacacaggatgacagtctcaccatcagaaggctggaaggcacagccatgtgcattattctggggctaagaaaagcagttgctttagctccacatagggaggttttatttaattaggatttgaaagtcatatcaagtggctctatttctttctaacaaagcccaatgtatttaattcctataaatattttagctaacctgtcagtcacatactttttaatataagggtagtggcacataagtgaaaatggaatacacaaagagtttcaaattatgtgtaacttggtagagggattaggaggcatcttgtaaagatgtggcatgtctagtgtttcactttgttttccctaagagaagactgagtaatagaaccacctttttattttctccttctgcaggcctgctgcctgtgattgatagctattaaattaggttttacctccccagattggtccagattaaatacacttatagcacagcaagccactgagaacaaaggaacaagtggcaattactttgtctattttggtcttcttcatagttaaccatcatttaagcattcaaaggaaaatggttggaagacaggaacgaaaggaaaatgaatgaaatgagaattaaacacatttcattgtaagttcctcaaatttataaatataagcttgcacacaagcatatttcttaagagaactgacttcaaatgcagaagcaaaagaggaatctcctggaatacataagtttattgaggtgatttgtagtataaccatctttcctgacctatcatgggactatatgtcagtcatatttgaaaagaatttatttgggaagaattccacttgttcaggactcagacagaagacagaatcacatgcttcctagacagtgatgccaaggttattactttgaaatgagtagggtcaaagtcatgctgatgagagaaaaatgcttttctcatgtgaaattgtgttctcttaaagataaataaatgaaatcatatttgctgtttcaaagtgtttgccttccgtgttttgtaaggaaatgatggcagcctccactcttggaaaatcgaactgggattgtagcacccatcattcttctctttctcaagagatcagggtcttcactccctctcactctatgaagccagtaaagtgtagacatagggaatccatatttcacatactgcccaaacataaggtcgtgcagagcacaagaaaagagagagactgtatttccatcacatgttggaaaattatgtttcttgaggtgtgtgtgtgtgtgtgtgtctgtttgtctgtgagttagtgtgtctgtgtgcttagtgggtccagggatgcaccagataagggacttaggtaaaggtggtaagaagattaaaaaaaataaaataaaaaataaaaaataaaaaaacatcaagaggaaaatctgtgtggttatgtctgagggtctcgtgtgtgaatttcctcccgttttgtggcattaaaaatgagttagttaaataaagtagcatttgcaagttcttctcctctgttctattttcagaaagggtcagaggaagctcatgatctcctggagagactcaatcagagctggatctggctgggaggtcacattggcccacccgatgtttgttactcaagggagagaatgctccagagagcacggtgtttttagcatgagatgtcatgaagtagtcctcggatttttctccctttgtggggcagaaagtagagctttgccatatttgctcacagataataagggacatatagaacaataaagaattccacttctacagtagatcttgggacatcagctagggtaggagtcactgtgccaggacatacacttctgggattgcctctccttcccagaaatgtgtttctcagtttggcctaagttggacattgtatcagttgaatggaagtaagtatttaaagggaatgcagaagcaagatccaatgctctataatgttggattgatctatgttttgggggcctccatgcagaaactcaaatagtagaacaaaggaattactctagaaagcagaatgtgtgtgtccagccttgatttctgtagccagataacttaagtctgaaactgtgaaggctctgtgatgataactatctatttgtctatcgatctacacacacactctctccctctctctctctctctctaacagggacataagacttctggatcatggatcagactatttagtcacagagcagcctgcatccgtgccttatgcccaaacacctcccgggcagtgcagtaagaaccagatctccctgtgcatataataggtattgtaccattaaaaaaggaaccccagttagttgggcatgatggcaaaagcctatagtcctagctacttgggaggctgagacagaagtattgcttgaacccagaaggcagaggttgcagtgagccgtgattgtgccattgcactccagcctgggtgacaaagcaagactccatttcaaaaaaagaaaaaataaataaataaaaggaaccccagaattatgaaacacagagattatatagggtgcttttccatctgtccctgcatcgctctggagagatataaagagacttttgctatgcaattttaaaaaatcatcttttgggagggaagaaagaaggtctttcctccaacatcctgccatgtaagcaaatgtcttcaggggagagaggaagtgtctatgtctccgaagctctctgcctttacacttttggacagttggggccattacagttgtccgtcaatcaccctttaacctgggtgctgatgttctttgctcagaaggctccaatcatacagaaacatgaaaatattcataaagagttgtttccctacaagagccagataataattcatctcttcagagtgtggttgtaaagtagaatgagattattcagggatggagataagaagtaatgaaaatcaaggaccagtcaaggaatagagaaagtatgtaattccttcagcctctaagtggaagtagctttgcctatgtagggccttctactcgggagttttcacctgtcctccataatgcactatgcatggaatacgaatcaaggttgatgcatccttctgctgcagttgccattctgccatattatattttcctgttttccatgcttcattgagattgaaactttcctatttatgactatagtccaagctctagcatcaagcatggtacttggaatgtgaagcatgtttaataaaataatgacctatgtgttattcccttccatcccaaacaatagcttcctagctggtttcctagtgcatattcctaactttcattatgtgatatatacaccaggaaaatgatgatgatgatgatgacaacgatgatgatggtgatggtgattttggtggaggaggtggagattattgagttagggaggccaaatttaatatcgcctctattattaagctacttgattttcaaaggtgttgcttctccacctataacataaataataatatcaattatatttaatacagtaatatctatcttaaaataactaaataaaattatgtaggtacagtacttagtatggtgcctagtgcccagcagggttgaaaaatgattagtgactgttatttatcattgttgattttctttttaaaaagcagtaaagcataggaggaaaagtaaggagagggaggaaaatattgagtttttttaggttaattctattaggctttgctccctgccaagtcattgttataaacaatccaaggagagaaggaatgtgtagaagagatttaggaaagaatattatgagaccaaatcctccaaatgaatcccagtccatgcagaaattgtactggcgacagctgttagatttgggcagagactaatgaagaattataaaggaggtataatgctgattttaattctgaatttgcacaggggtcattccaacgtcaaaaataattataaacaaagagatttcagttgtagttttgacactgtgcaagagctaggtcagacctctcatgagggctacagcctcccttatctctatttttacaatctgttctatgtatcctcacgaaatagacagacactgtatacctacttgtcaatgttggtgaaatgtcctaagttccactgaaaaaaacatatcaaaatattagcattactaaggaatgcattgcactggatatcttatttctttttctaattcaactgtaaaacacaaaattaaaatggcgaaataatgttctttgaatatctttgtatccctacatttctccccctcccactgccacctctgtacttcactgcaatctaggctgtcatcatcttgtttatgaactgctgtaatagctgcctacagggttttctctctcctgttttgttctgtcccctgcctccagttaatctattgtccacagcagtcagtacgatacatacatcagataaatcaatatcttgctgaaaagcattcaatatcttcctattagggagattcaaaaccctcaacattgcatagatcttccagttcctactctgatttctttgcagtgttctttatcatttcctgacactctaccctctgtttcatacatctttcccactctggaatatgcagtttcttctaagtggaataactgctattcaattttaagaccttaccttctgtgaaactactagaagaaaacataggtaaaagcttctcgacattgatctgagcaaactttttgatataatctcaaaagcaaaggcaacaagcaaaagcagataaataagattaatttaaaccaaaaagcttctgtacaggaaaggaaacaatcaacagagtgagtgaagagacagcctatgaaatgggagaaaatatttgcaaaccatttgataaggggttaatatcacaaatatataagaaattgaagtagttccatggcaagataacaaaaagcatgatcatataaagagcaaagaacctaaatagacatttctttaaagaagacatacaaatggccaacgggcatatgaaatgctcatcatcactaatcattaggaaatgcaaatcaaaaccacaataatatatcacttcacacctgttaaaatggctattatcaaaaagagaaaagatagctagtgttggtgaggatgtagagaagagggaacacttgcacactgttggtgggaatgtaaaatggaaaacagtatgaagaatcctcaaaaagttaaaaatagaactatcacatgatccagcaatctcatttctgggtatatatccataggaaaaaaatcagtatgttgaagagatatctgcactctcatgttcatggtagcattagtcacaatagccaggatttgaaaacaatccaattatccatggatggataaatggataaagaaaatgtggtatatatacacaatgcaatattactgagcctttaaaaaggaggaaatcctctcatttgtgataatatgaatgaacctagaagatattgtgctaagtgaattaagccaagcacagaaagacaaatactgcatgatctcacttatatgtagaatcataaaaagttgaactcacacaagaaaactgtagaatggtggttgctaggggctggggtggggatggaaagctattggtcaaaggataacatttcagttaagataaataagttctgaatatcttatgtgaccatacttaagaatattgtattatatatttgaaaattgctaaaaagaccataaatgttctaaccacaaatacacaaaaagataaatatgaggtgatagatattttaattagcttgattgtgttaattatttcaaagtgtatacatatatcaaaacatcacctctatatgagaagtcactcttcattctggatcaatataggacctactgaaactgtcatttcctccatcagaattcatatttcttctatcatattacttttttcaatattatctgtagtctctgatacactaacaatatcagttatttgcacctaacctctctgttctatgagacatatctctgttacagaaaaattggaaggaatgaaaagagaaagagatgatatttagcattttgtttcataaacactaacttgaagctcacagcctgcacacaatcatgaaaaccaagatgccgaaattacagacagaagtattttatattataaaatttctgcagcctactttttttttttttttttgagacggagtctcgctttgtcgcccaggctggagtgcagtgcagtggctcaatctcggctcactgcaacctccgcctcctgggttcaagccattctcctgcctcggcctcctgagtagctggaattacaggtgcctgcaactatgcctggctgatttttgtgtttttagtagagatggggtttcaccatgttggccaggctggtctccaactcctgacctcacgtgatctgccctcttcgcctcccaaagtgctcagattacgggcgtgagccaccgagcctggcccacttacctttttaacaagccataggatagagatgattggcaagattgctttaagggaagatctcataaagcaatcttgggggtgatgcttcaagtgagagaaagcaaggatggtcacaacattgaagtagttgggggaaacatcgtttatgtgtgtgtttgtgtgtgtgtgtgtgtgtgtgtgtgtgtgtctgcatatgtgcttgattcctacttttcatttcgtcacctgggaaaactgcaagcccagcagagaagctactatatttaccacaatgtaacacagtgccacacggacagaagtttacaaactgagaagccttacttagagaactatggcatggagaaagcaggtaagggctccagagtcccaagaaatgttgtgaccactggttgaccagaagatactacgagttaagatgaagaagtcacagaatgcaggaacttactaccatatctagaaccttagacttcagtaatgaatgccattacataccaagaaaaaacaattatgcccaactttatctcagtaggctacagttcaacataaccagggcccagatgggaccaatcacacttcatctgatattcttggaagtcaagagatagcacctggacaagggaactctcttccaatgatgagatgatcagtaatatttcttttgcactcagacgctatcttagataggtaggaggaaaagcaacaaaacccttttacaataagagacaaagtcttgattgtcactttcaacattagactgagtatttatgtaaaaggcactaagttgaaaaataattaaagcaaaagaaactgcaaaaaacataagtttgagttctattgctactaacattgcaagcgagaacgtgagttcacttaaatgagatataacttctaaatttccattttgctctacttacagaatgcattgttcctgataaggctcatttttttccatatgtaacattatacctagcacaaagaagctgccttctatacatttgttgaatgacaaagtaaatgagtaactaatgctgatttaggaaaggtaacaaattagtgattaacttctaacatgtcctcttaactgttagccacaaatcactatttctacacctcctcccatctctgttctccatgtccatgtcacaaagttcaatccaactgattttttttaatttcacagaattttaaaatatcagccatatgttttcactaaaatccatagagacaaaaccatgctaccagccagcatttgctctttgtttcaatgtacagtatcctatatttgagccatatgacttatgagaatttttttttttttttttgagacggagtctcgctctgtcgcccaggctggagtgcagtggtgcaatcttggctcactgcaacctctgcctcctgggttcaagcgattctcctgcctcagcctcctgagtagctgggattacaggcgcgcgccaccatgcccggccaattttttttttttctttttgtatttttagtagagactgggtttcaccatgttggtcaggctggtctggagctcctgacctcatgatccacccgccttggcctcccaaagtgctgggattacaggcgtgagccaccatgccaggccgagaatttttaaaaatgtagtgtttccttattttcccaagacttgatggaggatgggtaaagggatgcataaaagcacatttaccttttgtactagaaaaggcctggggtccatatctggactatctgatcttttccaatatgtgtaaatttcttaaaaacaaatgaggattggctgggcatggtggctcatgcctgtaatccctgcaatttgggaggccaaggtgggacgatcacgaggtcaggagttcgagaccagcctgaccaacatggtgaaacaccatctctactaaaaaaataaaacattagccaggcatggtggcatgcgcctgtaatcccagctactcaggagactgaggcaggagaattgcttgaacccgggaggtggaggttgcagttagctgagattggcaactgcactccagcctgggtgacagatcaagactctgtctgaaaaagaggaaagaaagaaagaaagaaagagagaaaaagaaagaaagaaagaaagagagaaagcaagcttactttttttaggttcatctcacaatattcttacaaaatataagatttctacaaaacctaagatttataaaatctaagaaagctgaaaggcaaactcaagcattaaaaagtggaactttagaaaatcacagaatgttatccatttctccactattatatcattttaagttagcagatgtcaatcaaatattttccagataagacagtcatagtgccacatgttggaagaaacaaaaactgggttggacaatcctgtccccaaatgtgcataggctattttaatgtattttttatttttcaatgattcttcataaattctttgtccttcacaacaaagttcttttggcaaaacactaaggagataaaatgtattcagtacagacatgagataggacaaaataatatgatgggggaagggacattggagaggagaggagaaatgagcactcgggagagaggaaagaaatagaatgatcctcaacaatctatttttacttgacctttgaaggactctggttatatattcttttctctatcttgccctaacccttctaaaattattaataaaataaaattataggcataaaatactacctaacttaactttaaaatcaatattatgagagattaacaaaatagccaattttcctaagtaatcttaactcaattaagcacttttcattaaacattttgacttgttaggggacaactaaaactgtctgcgataataacactatagtattttttataatgtgaatcagcaggacattaaaacctaactttctctaatcttcctaaacatcatatctgaagtgaaatatgtgttaaatatatatatgcacataaagtggtaagaatttatttaagtaaaagtaatcctttaaagaatggagtatgaaaaaataaaatgaatatgcaaatttttggaagatattttgtatattcaaattacatatttgaacgtatatgcacacgtcattaacacatatatatgtcattaacctttactataattctttcagaagttatgatgatataaattacattttaaaataaaaaagaaactcttgtgaatgtcaaacacatttgccttcactgttgtactgcatgctaacatatcttaaaagtggccggacatggtgactcccgtctgtaatcccagcactttgggaggccgaggcagtcagatcgcttaagcccaggatattgataccagcctaggtaatatagcaggaccccatctctatagaaaaaaatacaaaaaattagctgtttgtagtggtgcatctctgtcgtcccaggtactcgagaggctgaggtgggaggatcctttgagcaggggagggagaggttgcagtgagctgtgatcacgccactcactgcactccagcctgggcgacagagtgagatcctgtctcaaacaaacaaaaataccaatgtaatatgtggaaacattattgagcaataaaaagaaataaagtattaagacatgctacaacatacataaacctcaaaaactttatgctaaggaaaataaagaggcacaaaagaccactttattgtgattcaatttacatgaactctccaccaaaagcaaaggcatagaaaccagagtagtttagtgaccgtagatatggacacatggagtctttcgggtgtgatgaaaatgttctaaaattggattgttacaatgcttgcacaactccatagatgtaatgaaaataattgaatcgtatacttaaaatatatacataacaatattatgacatgtaaatgacaccttaataaagctatttttaaaatctgaccatttactcttggataaaattgtcaaatatttagactacacagaaaggagaaaaatgtataacaacagaatacttaaattttggaaacatttttgtggtttttttattctttgaaaaagcaccctttccgaggagtatgtaaacatgtaacttctttaggttaaatggagaaaaatgtatcctttgataaagaggataaatcaacattaaacatcgtttaagggaacagtcagagttagcatttatttatttaacaaatatttattgagcatctactaagagccaggtcacgttttaagcactggggataaacatgtaaaaaaaaaaaattagttttaaggcttttaattttttctccattgtttccaaaccttcagtgaaactacacttaacttctgtaaaatccaagctgctttttaatgaaatattttaattaagcatgtcacttttttaacttttttttttttttctttttcatttaagatgcctttttcagatcattcccattctcattaaacttcacacggatcatgacttttctgttctcacaaatgcaccccaactcagtctcagggcaagaccagctctttttgtgcaatggtagggtttacctaatttgggttggaattttcaatacatgactgagagaatgtttcagtctacttagtaggaaccttaacaagaaaagtggacctcagtacagtgatgttatgctaggaaatgggtgtgtctgtgaggaaattttagaaaaaggtatgatttacttttcctaggaatagtcagacttagcgtttatttatttaacaaatatttattgagcatctactatgagccaggcaatgtgttaagccacgggaataaatatgtaaaaaaaaaaaaaattaaggcttttattttttcttcattatttccaaaccttcagtgaaaccacacttaatgacctttttagcagcattgtgactaattaaaaaagggaccataccaatggttgggaaaggctaatgaaaccaagtacagtcttccctacactgcacttcctccgtggtccctcagaggtagggtacagtagtgagaacttctaggggataccctgcagggagcaggcttggtcttcagcagaaacgcactctgagcaagggtaactcgaagggactgactgagaagcaatggtgctcaattatgaggttcagataaatcacctgcagactcattaaactaaatccccaggatccagtctcagaaagatgaatacagtagaaggagtgagtaggagctaggtcttgacatgataggcataagaactgtccgcgtagggcagaagcaggaaatgaatttcgaggaagagttagccgtcctctttttcaaagtccttaagaaaactgacagccagaaaccatcatagccaacatgaattctctttccaagttgtaaacaaataaaggcataccagctatataggtttatgaagctgtaggctgattttcatggcagccaaagtaagcataagtcatatgaattgttcttataacttaaaaaaaatgttttaaacataaattaagccgcaagaatggagggtaaaggagagagtattttttttattaattaaagggaaatttgatacagtgcttgagcagtgacaaatacggtaacctggagaaactggggctggcagtatctgagtgggcttttagaggggtaggactcggtcaaatggatggtaaaacaaaacaatgattattacaggcatagtgctgtctctgtcattttctcatgctgttccttctgagtcagagaatgacatcgtatagtcgtttttaaagtaggaattacttgcatgcaatcctttttaaatgtaatgtcttgttttgccagtaacacaattgtccagtaggctcattagaccaccaggacactgatagagttccacagctgagggaggcataaaagtcaacccaaataaaagttaagtttcttcaactgatattttttacataagaataattcatatgacttcaggttactttggccagcattaaaatcagcctgcaggcttcaaaaaccactacagctgacatgagggatgatgcccacaatgacacttggtggtgggaggaagctatcatggaatcgcaatatttgggcaatttacaacgcgatgcccatagacgcaattgaaattggtaacatccagatttcatttatggtggtatgcttgctgactagccacaaggaaagatgatatcctgtgatggaaatggtaggaatcaaggtgcacattttctaggatgattttaagcttagctaagcctgtacaataaggaggacagactagactcatttctgaaatgctatttgattgtttttatgaaatagactttattttttagagaagttttagattcacaacaaaatggaatgaagagtagagagttcccatatactctctgcccccacacaagcacctaccccattatcaatatcttataccacaatggtatactggttacaatggatgaacttagattaatacatcattatcacccaaagtccacagtttacattagggttcatgcttgatactctacattctataggttttgacaaatatgtaatgacatatatccactattatagtatcatacaaaataggttcactgccttaaaaatcctctgtgcgccgcctattcattgatttctctctactcttccctggcaaccaatgaactttttactgtcttcaaagttttgacctttcaagaatgtcatatagttggcagcatacattacacagttacacagtcttttcagagtagcttccttcacttagtcatatgcatttaaggtccctccatttcttttcatgacttgataactcatttttttttagcactgaataatattccattgcctggatgcaccacagtttatccattcactactgaaaaatatcctgtttcttccaagttttggcaattatgcataaagctgccatacacactcactagtaggttattgtgtagacataggttttcagctcctttaagtaaaggcaaaggagtgtgattgatggatcatatgataagagtatgtttagtttgataggaagctgcccaactgtcttccaaagtggctgtaccattttgccttcccaacaacagtgaatgagagttcctgttgctccacatcctcaacagaatttagtgttctggattttggtaattctagtgatgtgtgtaatagtgtcccatttttgttttaatttgcaatttctgaataacttttttattctgataatttataattctgcaaatttatttatttagccctcaaactgggaaggaaattatttttaaaacccgtatctttaattatttgatgatttattcttaccaaatcaaagttcctaacttttctttcaatacaactgtgtccaatgtaacattaattaagcatttttaatcctgatctttctgttcatttaatccagtatgcactgagcatctatctattatcagtcactgtgaagataaagcaatttcccttaaaagaaaattataaaatcatcatttttgacaaggctgatatactttggtaccaatgacaaacctaagatagtatcttgtgcataatgtttttagcattagcagaattaatgtggttttctcctcctctggacttttatcaggcttgtgtttttatctagtacaatttatttccctattgacatatcttttatcttaatgaactaaaatattaacatgattcaatacaaacagtagtctattcttgcatcacgttttatacttactagcatgtattttaatcattgccacaaaatttcaaagtgataacggcttttacaaattactttccttcaaagagaaggtaaaaagaagaaactctcccttgataagggagggtttatcagtggtattctattagcaaagtagaagagatcagaacagtatgggggggtggggtcatgcaattacctttgaggaagtaagccatatacccgctatcaacatagtacagccatacttatgacagtgaagaatcctcaattacatcaacctgccccggctcagttctatgggtgatgcttcaaaagccattttaaaaatatcactcaagtagatattagcataatttagccattatttatgaagggtttagggtatgtcaactgttcttcctttttaatctttaatccttacaatagcctccgaaggttaaagtcactatagataaaaatggaacactaataggtaagaaatctgagtctcagagaggcttagtaacttacccaaggtcattgaggtggctaagtggctaacctaggagtcgaaatccaaatagatggtaaactcagctcttttcacccacactatactgcttctaaattggatcatggaatacgagtgtggagccaaagataaaaatagttacgcaatttcaaataaatccaaagactttccaaaaaaaaaaggcattgatttaaggttttatttacagaaaaacttcaaacaaaacatcaaagcaatgtaaaaaatggaatggaatatgcttctggtgtgcatttcttaccagaactatttcattcaataataaaaaatatggaggctgaggttgattgtcacaaacttgccatgagcatttcttcaataatatatattgaattaaagaggaacgaaggagaagggcaaggatatccaataaatttaaaaaaaaaggaaaagtaaggaatatagaactgtgtctatgaagatacataagaacatcaaagaggaccatgaaaaattcagggaaaagttaagagtctgaagaaccaaaggatattctaactaaattcaagaaagcttttcttgagaacattccaaccacgaaaaagtgaaatatggaacaaatcataaaggcaaaaagggcataagcaaaataattatttttataacctccatagtaccaaccataattctttagtttgctttgacgtcgacccttccgaggcttgatgttatgaatatttatatactgcataatgatagcaaaagacattcataaatggtagtcaatgatgttcagacatttataaatgtagaactggtctccaaaggcaatttggtcatagattacatgctatgtatcccagaaattatccagataaggttgacatattaccagagaggtacagagcatgagttagcactaaaatgatgcagaatggggatacctaagaaaatataggaggatattcaaatagggattgaattccaagatagattaatattttatggacatatagccaatggattacaatgattaaagactgaactaccactgccaggacagattagtgtccacgaaccccatttctaatgagaaacacagatagggaacattttaggaaaaaaaaaagtgactaatgatcttaatcacaatgtttggtacagttgaccccaaaccacaatgattagtcatttaataaaaagctactgataaataatatttctctagttactgatcaataataatggagtgcaaatatgactaaatgccctatacctgccctattgttctcataatctcattaaagaacaaagatataagaatattcatagtgtattcaatgtgtgaaaatggaagcatatatatatatatatatatatatatatatatatatatatatatatacaatctcctagaagcacacacatatggtggcagaaacagtaacctaattgtttactggagaaaaccacatcaagacattattccatgtgaaactgaataactccaaataaagcgaggaaaaatgtagattaggttcaagttgctcaatgaataatcacacttatttctcccaagagcccgataaacattgttagtctacattgcttctcaatctttgaccataaaaaagcacctcaatttagcaaagcacaatggttcccacaaagtacttaaggaaatcagaattgattctacttatattgattttggggaagatatgtgctacaaatgtggaacaaaaattatgatgttcaacagtcctaatgagtgcgtctatttacaagtgcaaaacaaggagatacaatcttgttgaaattttagtatctctgctcaaattagctgggaaaaagaccagtaccaaaggcgaagcaaatgatttttctgcattgtgcttacaaatgatgctcaatgaatggaaggtgaaaaaccagacataaaattcctggaggaaaaatttaggaaggcaaattgatgtgtaatcaatagctccatcaatgtgcaccagcattcttggtaaaagcaaacaaataaaaaacaccaagatcaaagcaaagaatttaagagtagcaggctacaaacagaaggtaacatggaccaggtcagatagttgaaccacagttataatcaggctgattttttttttagtagtgccatcgtcattctattaccagaatagatgattatcaactccagcctaagtttcatttctgaattctgaaacaaggtctcttgcaagggaggcagaagaatctctagatcgaaggatcagccatacctaagtctttctgtcatctcaaaggttaaccttgtgtagtagattaacttattgaccccaattctttcacctatcataaaattgtgtaccaatattattgccttatagtaggtggagtataatttactatatgaagaaatgagattcgcttaaaccaacaggatattaaaagacatgatgcaagctgaagcttgaaatatacatacgtaactaagttttctgttatgatttagtgatcagccatcaaaagaacattccctaggaactgttgtctattcagtctgagcccaaggacaaaaatatatggggctgggtgcagtggctcatgcctgtaatcccagaactttaggaggccaaggtgagaggaacacttgagaccaggagttcgaggccagcctgggcaaaatggcaagacccccatctctattaaaaaacaaacaaagaaacaaacataaaatagacctaaactgaacctctagcctttagccacacctagctaacccgcaatgtgaagaagagctatagcttcagccaatttagatcagacaaaatgagtgtgagaataaatactcattgtagtttggagttggttctcagcattattgtggctatagctgactgatacacatactcctaggtgtcagtaattggtaccttaattatcttctcttctcaatcatgccccagccttctagtctatctccaataaccgggtttatcctctgctatagccaatttccttcctaatctgaatctctttagctggatatttgctaacacttgtcacactttcccgatattctgcctaatgaaacttactatcgacttgcttccatataaataattatcaactgatttataaataatacaagacaaataacaattattaatattatcatttgttaataaagagttacaggtcaggcacatttaaatatgtgttttgtttaactttcacaatactgcaaggctgattttataatcggtattttctgggttcaatttctttattctttactactatttttattccaggctctcagctcagaagtaacctgcccaagatatcccagacagctggaagagatgccaggattcaaacccagatgctgctattcatgctcttctatgtcacattgtttaaacctcagcatgacgttttcaagtagtaaaacagatattcatgttacaattgaataatttttaaggataagatttgtccattacatagatctaaggatactgataaaattccttttctcacctgaaagacagtataaaccatgttatttggcaagtaaggtcagaggcataaagagggttggataagggacaattctcataaaaaatgttatcaattgaatatattctaagaaaaattaatagtaaggttttagaatttgaactttttttctacctgggaaactgcctagaaacattagcatcatgtaacatttgagtgctgggactctgggaccatataggaccctctccccacccaggaccactctgtggcctgttaggaaccgagcagcacagcaggaggtgagtggcaggcaagtgagcattactgcctgagctctgcctcctgtcagctcagcggtggcattagattctcacaggagcatgaaccctgttgtgaactgtgccatgccggggatctatgttgcacgatcctgaggagactctaatgcctgatgcaacagtttcattccaaaacgatccccgcccccctccccacaaccctgtctgtggggggaaaaaaaaaaaaaaaggctttccatgaaaccagtccccggtggcgaaaaggttggggaccaccgatagagaactgagttcaaattctgtgtctaactttttctggctgggtgttctagataagttactgctttcttgacaccttagttttctcatctgtaaaacaggtctaagagaagtaataacttcatagagttgttgagggagttagatgaaaagtgtcttgtaatttagcacagtatccagaacaggtatattgtggtcatctcaaaacatatgcactgaaattctacagcatcattgaaaacaggggtcgctcttttctaaaggagattggccctttcaaagcacagagaaaggcagggactcatgaacaaagatggggagaaggtaaggagaggagcaaaaaacttaaattgttttgatatagtgtgttgaaaaatgtaaaccaagacatgatagagacatgcggacacgtgaatatatgtttgagggggtatagtgggtgaagctttttaaaagatatgactatgggttacatttcacataagcaaccagatgctattctagtcagtgggactaaggaagggctttgtttaaaggtggctagaagcaatttaaaatgcagcaacttccactttgtgctagcaagatcaatccatgttttgagctgctgttttcacctcttcattgtttatcaggtttgagtctaattgggcttgattggaatcatgggaagccactaattaaaatgattaacaatatcaataacagcaaagagaatagaaaagaaagcctcttatttttaatgggcagaacacggattcttggtgtctgaatgaatagaagttaattgaggactgacagtggataacacatttctgaaatgtctattttcatgcttttaataaaggcacattttctagaagaataggagctaaaccaaaattataaatacagacaagatttttttttctcctccactaattgaattaaagccaattcttaaccgcagaatgtttgcaggcaccttgttatcaacgacttctactggataccgtgcttaacactggttatatttcagctttgccactgacctttaaattgctctaatctgcttttatttacaaatgtggtttctgcaaatgagcgttggatagaacagattcgagacacactaacaggacacaatccaggctcaagcagaggaggaaacagcgagctcccagatcgtcttcttactattctgtttgacaatgtcaggatgccttatttccagaacacaagggaagtcatttagacggcacatttctctacttaaagtgttcactctctggctaaaagggggttcatcatgttgttcctgatgtctaatccaagttctgccttgaagtagatgagctcaatgtcaagaaaatcatgtgtttgcatttggatagtcttactgactgctgagactgatatatacctagtcagagcctgggaaacacctgagccttcctttccttcctactaaaatttaacccagaaggactctgaatgaaggcacaggaatgcttgataaagttacttaggttccaggaacttgaggttgccttatactttgcttattacatctttactctttttttggatatttacttcccattgatatctaacttctgaattatttctctcccttggtgtaaggataactaacatttgcacagaacaccattgtttctaaaatgcattccaaaaatcactacacattcccttctcgccacatctccattcaggtaaagcgatggagtgactttgtttaggaaacaggttctggagttctgtgaactgaattcaaagactgtctctgcactttctgtctgtgtaactttgagcaagttatttaaactctctatacctcatgtccattcctgtaaaatagatggacctactgagatcgccctgaagattctaaagagagttcttgtaaaggtgattagaatattgcctggcccagatcaattatccaataaatgtcggctggtttactacttgaattattatcactattctgtgagttctttcaggacatggtagcagaccacacttatctttggatacccctatgcctaacacagtgcctggcagatagcaggtgcttaatgaacaactgtgccatcgttttacaaaccaacaagtccatattctaacaccttcaatccttcagatggagccaggataggaaaacacattttcttattcaagtgcaatgcttttcctgccccagctatatcccatcaaggtgataacttatttattttgcctcatcccctggacatattagaatgctcagcaatggaaatgctccttccatacttgctgaattgaattttctcttttcaatgctgtcttctggtgtggcaaaaaaagcagaaggtaattgactgtttcactatgcctctctcactacattgtttctcaggcaccctatatattttttctttttaaaaaatatgtatccatattcctttagcacagctgttttcaacaacaataacaacaaaaaatttcaaagcaaggcatactttctttaaataaaatcttttccagaagccaatttttataacaaataaaaagcagttcttggatatctctaggaatttcaaaaagcaagactaatggagccttgaactcgccatgcagctgttcttcctccatttcccattccgttctcctaagcccctgaggcagttttgttgaacctttagggtttcagtgaacgctattttaaatccactgtctcaggcccagcaattttggatgctcctaggtgcaacttatatttaccgaacttctttgtgttagtggaactgcttccggttttcagagagagtaaattgaaatatacaaatgcagtattaaggatcttccaaagtggcttaactaaatacgcagtgatagtgttcctaagccagatggtaaagaaaccctaacttttttgtaacaaaataaaagggctgatacatctcttacttttaatcttgttttaattaaagctgcagtggctaaagtgattagccaacatgaagtcaatggaacttaaggttttatgtctttttattttacaagtgtgtgtgtgtgtgtgtgtgtgtgtgtgtgtgtgtgtgtgtgtttggttactgatctgaaggagaatactgatttaactttcatgctcttgttattttagttcatacatgtaaactctgttttccagcaataagttctctgagtcttgttatgatcataaaatattttgcttttgaatcattagatagtgtgccttgccagatattttcaaagcgtgtgttcatttaaaggcaaagtttctgtcttataaatctcgctagctcttcaagacaacctgcttataactatttacatacacctcaaagttcgaatgaggcccaggaaagagacacgagaaggccattttggtggtggggaaggtaatatttctttactagagctaaagatttctaaggattcttaatgcgatttttaagcaatctgctgctgtttaataaatgtatataaagttactgagctatgcaatatgttgtatagagatatgtgatctttttaaaacttaagccaatacagtgaattttgtcattttaataaaagtctagaataagaaatacatattactgtaacagattctttcctgtgggaatatatgattcaaatatgtcttttatttaggaatctttttctattaagagccagctgttatgaatgtgagatggtctatgcacaattatgttaccaatattgtatgctgaaaataatcagaagggaattttcatatgaaatctagatggttatatgaaaaaaggtaataatagactattaacagaataccagatatttaaactaatgtggacttgtaaataaaattaattcaaatttaagttcatttacataatcattttattaattatagataattaacatatgctcatttaaatgttcatttgaggttataacttaggcaacattgctttaaaaaaacaatttcaggagaatttcaggggtacagccaagttatattaacagatactggaaatgattaaaaagtagagaaaggacggggcgtggtggctcacgcctgtaatcccagcactttgggaggccgaggtgggcagatcacgaggtcaggagatcgagaccatcctggctaacatggtgaaaccccttctctactaaaaatacgaaaaattaaccgggcgtggcggcgggcgcctgtagtcccaggtactcgggaggctgaggcaggagaatggcgtgaacctgggaggcggagcttgcagtgagccgacatcgcgccactgcactccagcatgggcgacagagcaataatctgtctcaaaaaaaaaaaaaaaaaaagtagagaaagaagccaacaagagggaggtccttgtctggccatcacctgcacctgcctatgtctctcctatgatgtgggaatgtagatggctttttcaaggctatgtttatgaatatcgccattaaatatttttcctgtatatccgcattagtaaacgccctcccaacttctagtggaatcttaaacagagttaagtctatcacagtaaatgaaactcgaggtatggaaactcttccgtataattcactgatagtttcaaatatgactggctgactaatacaacaaagccccttcccaacctctcttccttgccaatctccactgcagaggctgtgaaatgtacacatcttccaagacttccttgcaagttaggatgatcatgtgatacattcctggccaatgggaggtaaacaggagtctgctaatggctgataaaggcagtgcttcctgatcaatgggactgacatggtcagagctaacacatcccttctcccttcttcttgctttgagtatggatgctatggctggaatcgagacagccattttatgagtgaaagatgctcacaatagatatcaaactggctctaatgtggttgatccgtaaaactgaaacatgtcattagcttccttcaaatttcttgatacatgaggaacttaaggcctgtttaaggcagtgctggtttgcttttctactgcagaggaagcacctatcagtagatctgttgacaagctatctattcatagtccatctactccactttataagcaaatttctgtgaatacttctaactctcacctacctcaccttagagatcacaatccaagctcaggctcctcaaacactctggtttaaaaacccagtgaacttgcttattctctgacccaatgacaaaggaaaatgaaagcattaaattcagaaccctagccaaaacaattagggtgaagaaaatggaaactttcaaattcactagtatccagcttaacattgttgcaatatcattaatagtacaagccatacaaatttatgtataagtaatccatttggactatacatttgaaattgtcaagtgagtatattggtgagtagaacctttacatgtgttcactgtaatgagaataaccttctcttaggtaacctactacacagaagtacagatcaatactcctaatgcagaaaccatttcaggaagtatcaaaagctatcaattgtcatctaattggaagattgtttttctaagtgaacagctataaaattctgactgttcaaatcactgtaatcattttatttgccctattctctagaggaaccttaaacaaaccctgcagtgattgctttgttatttcaaatcagcctagtaattttccagtgtattaaaagacattcagtgttgacactgctaggaaaaaaattgggcgtccgccggatggaactgttcattttcagtcaacataattactctgtattaacacatctgctatttaaacatatcacacttttttgctaataattaacttgatgggatcatacatctctattcgacttgaataaatatcagaatcatttttatattgttaaaatagtgccaagccaaatgaaatgattgggcttgagctatttattgtcagtaacataactcaattgcatgacctcctttaacaaagcaaaacaaatcaaaacaaaccagcctaactcctagatatatagcaatttatgtaatatcaggaaaaagaaaattaataaatataaaatattttttccaagaccttgaaggctgttttatgttatgaaatatgcaatcagtaccaaaggctgtcaaaatcatcttccttgtccacagttctgaccacattcttcctttctcaaacctccagggctgcctgtcatcttctgtatcaaatttaaattattctcactgcttcagggtcttctatctgcccttgtttatgacacctttcttttttttttttttttctttttgagacggagtcttgctctgttgcccaggctggagttcagtggcgtgatctcggctcactgcaagcttcacctcccggcttcatgccattctcctgcctcagcctcccgagtagctgggactacaggtgcccaccaccacgcccggctaattttttttttatttttagtagagacagggtttcaccgtgttagccaggatggtctcgatctcctgacctcgtgatccgcccgtctcggcctcccaaagtgctgggattacaggcatgagccatcgcgcccggccacgacacctttcttaatgtccctttccccattgttcactcacaagagtcctaatttgtaggactttcacactgcaatataattgattagaagaatgaatgatgcatcaaaagtcaaaaagcacagaattaggcaaattatattacccttattgttttttgctcctcccatgggaaaaaatcaagaactactaacagatatttttcctactatgtctttctgtagtaaccactcatcctcctacgattactttcaaatctactgcacattcctcttcatttcaaataatttgtcagatatactaagcaggattttgtcattttaataaaagtctagaataagaaatatacattattgtaacaatttctttcctgtgggaacatatgactcaaatatgccttttatttagggatcttctgtaaattgtaaagtaggtttgaggctttggagaaagatttaatatttgttgaaaatctaatatacttacattacttcattacttcatttaagaaatatccactaaatatcatctatagaaaaagacaagatactcaagactggtcctactttccactgcttaattatttatgctgattttcgttttgtgttgtgttgtattgtttctttgcttttagttttcaaaatgtattctccttttgcattgttgctgagatcaagaaattgtactctgcactactatcttcacctccagaacctgccagtgaaagcttattgagttagagggtaccatagacatcttcctctcccaggcttgcagagattcgccaggaggaaaaaaaaagtgagactcttcataattttttccttcctagcacttgtggttcatcatgttaccaagcatcagtgccaaaagccctgactgatttttatccactggggtaatcaaaatcagttaggattcaagtaaagggcaaagatctttagtctataccctatggctttccatagttatttttgttgtgtccaattcatctcctcatattctaccttgaatttgtctagtcagaaaccactgttagctaggttgataatgattgctgcattgctaaatacaagagataatgttagtccatctgttacttggcacttcaggaacatttgatccagttgaccactctcttctcctacaatttgttgcttctttagcttctagcacacaatttcctaattttctaccattttcactgatggctttccatatccctttgctggttctttgtacttttctccgcctctcaacacttgagtgtctcagggttcagctcatgtaccccattcttcttctatcattacttattatcttgatgaccttatccagtctcatagctttaaatacctttgatatgctagcaactcccaagttcacctctatgttatggacagctaaggttcatattcaactgttcttaaatatctaataggtccctaaaacttaacatgaccacagccaaactcttaaggattcatctgtatcacttccatttgatcttttcaatctcagttaatggcaaattccttctttcagtttgtttccacattgcttaggccacattttcttctttttctctcacaacccatatccaatttgtcacaaaagcatgtgttgtcactacgacaaaacttatcaacattggaacatttctcatcctttccagctctatcttatccaaaccccactctctctaatctgtatcattgaaataatcttccagctgacctgttcccagctcaagcctagtgaagtcagtcatcactattttctgtgcagagcctccactagcttctcatcattctcaaataaaagccaaatatcttgcatggcctgaaagtcctgacactcctatccctccctctgtgtgaatgtacttctcccagataagtgcatggcttgccccttcactccatactgctgtagaatatgttagtataatggttaattctatgtttcaacatatctaggcaatgtcttcacagcctagacattgctgtgaaggtatttttaaaatgtgattaatatttaaataagtagactttgaataaagcagataacatgggtcgactatacccaatcaattgaatgccttaagagcaatgacaaaggttttctgcagaaggaattctcctcaagactacaacctagaaaccttgcctgagtttgcggcctgatgctctaaagaatttggactcaagattgaacattaaccaggctcttgtaaccccaccacactgggagcctgaggtaagagaattgcttgagcccaggagttcgagaccagcctgggcaacatagtgagactccatctccacacatacacacaagattagctgggcatagtcatttgtgcctgaaggtccagccacttgggaggctgaggtgggaggtttgtttaagcctgagaggttgaagctgcagtgagtcattacatcactgcactcgagcctggaatcaaacagacacaataaaaaatgataaaggggatatcaccactgatcccacagaaatacaaactaccatcagagaatactataaacacctctatgcaaataaactagaaaatctagaagaaatggataaattcctcgacacatacaccctcccaagactaaaccaggaagaagttgaatctctgaatagaccaataacaggctctgaaattgaggcaataattaatagcttaccaaccaaaaaaagtccaggaccagatggattcacatccgaattctaccagaggtacaaggagacagtggtaccattccttctgaaactattccaatcaatagaaaaagagagaatcctccctaactcattttatgaggccagcatcatcctgctaccaaagcctggcagagatacaacaaaaaaagagaattttagaccaatatccctgatgaacattgatgcaaaaatcctcaataaaatactggcaaattgaatccagcagcacatcaaaaagcttatccaccatgatcaagtgggcttcatccctgggatgcaaggctggttcaacatacgcaaatcagtaaacataatccagcatataaacagaaccaatgacaaaaaccacatgattatctcaatagatgcagaaaaggcttttgacaaaattcaacagcacttcatgctaaaaactctcaataaattaggtattgatgggacgtatctcaaaataataagagctatttatgataaccccatagccaatatcatactgaatgggcaaaaactggaagcattccctttgaaaactggcacaagacagggatgccctctctcaccactcctattcaacacagtgttggaagttctggccagggcaatcaggtaggagaaggaaataaaggacattcaattaggaaaagaggaagtcaacttgtccctgtttgcagatgacatgattgtatacctagaaaaccccatcatctcagccccaaatctccttaagctgataagcaacttcagcagtctcaggatacaaaatcaatgtgcaaaaatcacaagcattcttatacaccaataacagacaaacagagagccaaatcatgagtgagctcccattcacaattgcttcaaagagaataaaatacctaggaatccaacttacaagggatgtgaaggacctcttcaaggagaactacaaaccactgctcagtgaaataaaagaggatacaaacaaatggaagaacattccatgctcatgggcaggaagaatcaatatcttgaaaatggccatactgcccaaggtaatttatagattcaatgccatccccatcaagctaccaatgactttctcacagaattggaaaaaactactttaaagttcatatggaaccaaaaaagagcctgcattgccaagttaatcgtaagccaaaacaacaaagctggaggcatcacgctacctgacttcaaactataatacaaggctacagtaaccaaaacagcatggtactggtaccaaaacagagatatagaccaacggaacagaacagagccctcagaaataatgccacttatctacaactatctgatctttgacaaacctgacaaaaacaagcaatggggaaaggattccctatttaacaaatggtgctgggaaaactggctagccatatggagaaagctgaaactggatcccttccttacaccttatacaaaaattaattcaagatggattaaagacttaaatgttagacctaaaaccataaaaaccctagaagaaaacctaggcaataccattcaggacataggcgtgggcaaagacttcatgtctaaaacaccaaagcaatggcaacaaaagccaaaattgacaaatgggatctaattaaactaaagagcttctgcacagcaaaagaaactaccatcagagtgaacaggcaacacacagaatgggagaaaatttttgcaatctactcatctgacaaagggctaatactcagaatctacaaagaactccaacaaatttacaagaaaaaaacaaacaaccccatcaaaaactgggcgaagaatatgaacagacacttctcaaaagaagacatttatgcagccaacagacacaggaaaaaatgctcatcatcactggtcatcagagaaatgcaaatcaaaaccacaatgagataccatctcacaccggttagaatggcgatcattaaaacgtcaggaaacaacaggtgctggagaggatgtggagaaacaggaacacttttatgctgttggtgggactgtaaactagttcaacaattgtggaagtcagtgtggcgattcctcagggatctagaactagaaataccatttgacccagccatcccattactgggtatatacccaaaggattataaatcatgctgctataaagactcttgcacacatatgtttattgcagcactattcacaatagcaaagacttggaaccaacccaaatgtccaaaaatgatagactggattaagaaaatgtggcacatatacaccatggaatactatgcagccataaaaaaggaatgagttcatgtcctttgtagggacatggatgaagctggaaaccatcattctcagcaaactatcgcaagcacaaaaaaccaaacaccgcatgttctcacttataggtgggaattgaacaatgagaacacttggacacaggaaggggaacatcacacactggggcctgttgtggggtggggggaggggggagggatagcattaggagatgtacctaatgttaatgggtgcagcacaccaacatggcacatgtatacatatgtaacaaacctgcacattgtgcacatgtaccttaaaacttaaagtataataaaaaaaaattattcccaaacataaaaaaaaacttatttctttcacttagcatattgcatttgaaagttatatatgttattgggtatattaatagttcattgctttttattgtcaagtaatacattctattgtatggctatatcagaatttctgcaatcactttagttgaaggacatctcgattattccagtttcaggtgattataaataaagctactataaacaggtgcatacagaaaaaaaaaaagaaaaagagactgaacatcaactgttatctgaatttctagcctgtcggcctgccctacaagttttatacttgccatagacatattagccaattctttaaaataaatctgtctctgactctctgtcatatatgcatctacatccatacttttatctttatctttaacagaaaggtagaaggagatttgataattgaaaaagtaggccatgtgaaggtggagcagaaagagacttgaagatgctggccatgaagatcggagtgatgaggccacaagaaatgccagcagccacccagaaactagaaaaggcatgaaaaaattctctcccaggcctccagaggaagtgcaacctgctgacaacttgatcttggcctagcagtgttgatttcaggcatctggactccagaattgtgagagaataaatttctgttgttttaagtcaccaagtatatgctaatttatcatagcagccacaggaaactaatacagtagtgacttgctcatctgcaggggatacattccaagccccctagtggatgcctgaaccacagatagtagcaaatcctatatatacaatgttttattcctatacatacacacctatgataaagtttaatttataatttaggtacagtaagatattaacaccaataattgataaagtagaacaatcataatacactgtaatcaaatttacatgaatatgatctcactctctgtctttctcaaaatatcttattatgttgtactcaccctttttttcttgtgatctgctgacctgcttgaactgagagctactaagtgattaacaggcaggtagctatacagcatggatacctttaacaaaggaatgactcacatcccaggcaggatggagtgggattgcacaagatttcattatgctactcagaatggcaagcaactttatacttacaaattggttatttttggaattttccatttaatattttggaccaggttgaccatgggtcactggaactgagaaaaatgaataaggggaactactgtaggtattttgatactgctttgggaagcaagatgaggctataacaaatgcctaaaaatgaggaagtagctttggaattgagaaactgttggaggctggaagcattttgagaagcatgaaagaaaaagtctagattacttataatagatttttggtagaaatataagtgctaaggattctgccagtaagggatgagaggaagtgaggagtacaatagagaaaggttctagcatcttagagaatatctgtatatcatcataaactgattgttggtagaaatatgaaagttaaaggcttttttaagggctcaaaagaaaatgagaaacatgttactggaaactggaggaaaggcaatccacgttttacagtgtcagataactgagcttaattgtgcccttcataattggaaagcggaacttataaactataaacttagatatttagctgagaatatttctaagcaaattgttgaatatatggcctgatttcttctcatggcttatagtaaaacgagagaagaaagaaataagttgaggaagaaactgttaagcaaaaagaaaccaatagcagatgattcaggaaattctcagcctacccaatatacaaaaaatgctaaaattatgagattcagtatcagaaaactgtgctctggacagaaggccaagggtatggagggacatcctttttacttctgctcaagagattagacatatagctgagggatccactcaactgtctcagcataagtcagacatagagaggcagttatccaggaaagatctggggagaacttcttgtttgatgatgtaaatcctcctgacatatataggaggtccatcaagtttttgagaatattataccatcagaaacattgccagcctggactgaaacggagagagacaaggcaaaaataaagaaggttattggacttccaaattctacaggcaggaaacaggctgaaatgactactcagctgcaaacattttctattcttcaagaaagaagaaaaatggcagtgggctttgtggtgtggcaggcctagcagtcaggggcccaggcccagaaggtgctggtgtcagcccaaagagcagaggtatgggctgaaaggacataaccttgagccacagagagttattcccagcccttacacactaatggagcttacttggttgaattttaaaattgcctgtgactcttctttaactcctattttttctcttttaaaataggaatgcctataaccattatcttatgcctataaccatgatcctatgctggtcccaccatttgtatgttggtaacatgttttctagtttcacagttccagagatagaaaagaattttgcctcaagatggatcatatttagagtctcacccatacctaatttcgatcattagataataagatttaggactttggagctgatgatattgtagtaatttgttatagcagccacagaaaactaatgcagtgagaagcacttttttaaaaattgcaacactcagtcatgctttctatatcctcccctcctttattttttccacatctccatatcacatatatttaaattactttaagaataagaaaacttatatatatgtatatatatatatatactactttttactctttttaaagttatttgtctccctcaccattgcaatataaactccataagtgcagcaatttttttatctttttgttttttcactgctgtatccctggtgctgtgaatagtggtactggtacataagaggtgctcacaaatgtttttcagtgattaaataaaaattttccttacgtatatcctcatagaatttgtccatccctccatctacattccatccatccatccacccaaccactttccatctctgtataaatccatctaccctcttacatgtctatttaatagcaaacattcttttactcattagccccaggatctgtgcaagaaattcaatggtaagtaagacttagaacaagcctacagagttatttcctcttcattgggaaaacagtagttgaacttgaactattaaaacaaaatgccataattatcactagcggggaaacaaaggatgccagggaagcaaattagaataatacctaatctagatgagaaagtcttcagaaaatactctctcattatacaaacctggagtatcatctttcttacaaccaacagataatgtaaatctatagagttctcaaacttacttctgactatactatagtaaaaaaataagtatttgtgaagaaatgagcatttgctttaaaattcatttcagcttaaataatattcatatttatgtaaagagagatgggtgaatctaactgtccacttaaatcttccttttaattcccaagaataaatgaactgtccaaagcacaatcaatattaaagacaatccagaatactttagactttccgtaggtaaatatcttgagataagaaggaaagtgtttgtctttcctggtgttcagcatttttgctgaccatgaaaaaagatgacgaagtaaagggtgggggcaagagaagggagaggaggaggaagaggaagaaagcaacagcagcattttaaaggcagacagcttgtagtatatttgaatttagacaatctcggttagcacgctaaattggaaacctgatagttcaatggatttagataagccacttcacacatcagtgcttcagtttatcagttacaaaatgagtttgacatttcccttgcctatctatggaagtattataagaaccaaatataagcacgtgcagatactttgaaaagtttaatttccttacaaatgtaagttatttttcacaaagacattttattgagattctatgatgtgctgatcaccatgtatagttatttgaaaatcacaaataatttgggatttgcaattatgagaattgagggcattaaactttagatattctgcttacagatataaggacaaatgtgtggttttaaacacagagcaaaaacgacataatagtgaatgtgcaataggataacaggtgtttcatacattgagaacaacaaaaaaattggggtaatggaaattcaatgtcctagtcacaggcagtgggggaattttcttagatctgtgataacagcaagtggttttgttaatgtgaagctagtttttgttctgtggttattgccattcctgagtaatgagcaacgagatctctttcccatctggcattttgtggctgagaatagcagcagcataaggtgaaatgtcagtggtaagacacagtggtttatgtcatttgtaaaatatgatcacagactcaaacatccatggtgatgtgatatcccagaaaatatcccaatgcaagtgaatccaactccatgggggcagtgaaaagagattaaagtcaaaaaatagttttgaattttggttccactaacttaattgcctgttttgctcttggcccttgatttttctcatttgtaaaatagaaatgaaaaaatccctatttttcaaagtcatttgaagaattaaaaatgtgaatgtcctttaagttgtaacatgctgtatagaagttagtggtaactgctgtttttgtagataaccaaaaaattgattttgtccataataacagatgaaagcttccttaatgaagttgcattacacagtcccaagctttaccaaacacgtcagtggtgttggtaacagttatcaaaactaccttaaggtggtgtctgtaattttcgctaaaggacatgtgagaaaatattttgaaaacgtctttactgctaacaacataccaaataggcttcaagtccattttcaagcccaaagtcaagttaggatttaaggaaaaggaaactagaagagaataattcttaggacatctgaacattcaagatgattggagattctcattcatttaaaagaaaagaatgttattccttacaaaaccttatttactgaaataagaatttcatactttgatagctaaatcaaataagggttctgtttcttcccccccaactccgccttccagaagctgggaaggataatttacctccctaactgcttgacttaacccacagggacgtaggcactgaggggatctgtgattatctacacaagatgataataagccagataatttcagaatttagaattttaaaagaaaataaaaaattctccctaatgataccactgcattgtaaattctacacatcactttccgtagacatcttctagcatacagctaagtgtcttatatcaaagaccctgccttcatggaggtgggagaaggaagttagaagctgccaagagaaaagaatcttggagagtaaagggtagaaatttctggaaaggtttgagtctttcctactgccattggcactgctcagtgggttgggggcttgggctctgtcatcacactgctttggttcctgtcctggctatgtttaccaactacatggcttcagatgacttaacctgaatggagataataacacctccctcatagggcagttttgacaaataactgaagaagtaaagcacttaaaacagcccttagcacaaaataagcacatggtaaatatcagttaccactattgtaactactaccatgacacccatggctaaaattatcatcaccattattagtagtactattatactattatttgtcctgcatgttaaagtgtttcttcaaagaagtcagagcatgggaagaaagccacattgtctgctatctctgaaaaaaaaaaaagagaaggaaaaaaaacagaaaaaaagaagtcctttttgaaaaagtccttcataatacttaataccatgcaagttttcagggtaaaggctgtatgccttaataaagggaatgcattcttttgttcttattttaattaatagtaataaacctgtttcattctgcatatatacttattcaagaagaggaatgtttttagtagatgagagtcttgtggcaacccatagtttaggcaccttttagccattattacattattttctaattccttatggccagtcattttagaactacaggctcaaagaaaaggtccccttgttttgcaagtgaagatttgtttcacaggaatgtgtgagtcagctgtctgatagagtgtgcaggtttgagggggaggtatgtgggggtgagatttaaagcatctaagatccctcccaatgttgacacttaattatctggaagaggataatgacttaaaattccagaaaagaatgattatgacaggaaaacataagtagtaacaatatattgaaccctttatatgaaagaggtagaaggtcttgtacctagtgaacataatctcattgaattcctccagcaatcttaaaatatgggttttatttacctcatattacaggtgaggaaactgaggcacaatttggcgatgtctctgcagagaactaaatgatcagcagaactgaaagccccatctaggcttattaaaatccaacaccctcactctttccaggatgtgaaacttcctggagcccttcttcatgccagtctcacccttggccctttgcctcagggagctcactcaagcctcatcacagagctagaagtgagctatgattatccacatgacacatgtgagggcactgagaccccaaagaatccccagaaagcagatctggcattcatgatcagcaacacaataaatgctgccttatagtgtttgattttctggtggcaagttatgtcttcttaaattgccagatgaacgcaatgcccatctcctttcagctagcacattttctctttgccagggaagcagtgctgcgtgatggctgagcacctaagctctaaagtcagactgcctgcctttaaagcactgtcctgtcactcaccagctggtgaacgtgtgaagtttcatccatttcttcatcttgaaacaatgacctctgaggcttgttgggagcatcaactgagtcaagtcatgtgaaagcattgggataatgcatggagcctaatgaacactcaaaaacattaactactgttgttgttacagttggcccagctagaatacactttgtcaatatggtcctcagaccattgcctcagaatctcacagggtaaggcacctctatcattaagctaaaaatcccattttaattcaacaattgaagacgtgtcccgagattttacttttctcacaatctcccaacagtgccaacgctgctgaacgaggtgctttaaatagcaaggaaccagggaactttattgactacagatttagtggaccctattccagacctagtaaatcagaaactctggggaggaaacccaggggaataaatgtttaactcactctctaagagattctaaggcatgtaaaagcttgagaaggccgtgagagaggcttcagttggttctaacattatttgacagtgcaattcactggagacacagtctgatcgaattcctgattcatcatcttgactccagggtaaaatgcttctgatatgctaagaaaccctcatccttttctgtaacaaaggtaatgagttaattttccaaatagggtaagtagataatccttctcaatttaccaacataactcacccaatattaagaagcattagaaaaggcatccattttgccagtgcaactaagcagtagttttctagcacaaatattagaggcaataaagaattttattcaaggttgacagctttagcaaacagtttctgttttatattgatgctctcttattttccatgttttctcagcattctggatatagcaccactaaaaaaattcttttggttaaattctgaatagtttaagctttaaaatgcaacttattggaaagatacaggggtaggaatccaagaaatatttggacaatcctcgagtagggcagtgaccaggttagctcatagggtgaccaactgctttagtttactcaggaccatcctagtatcagcactgagagtaccaagttctggagaatccctcagtcccaggcaaacaaggccagctggtcccactagtgccaacctggcagtaggctttctatggatctcttaatatgagtcagattacattgctcttattctgtccttttccaaattccagattcctgacaaagagaattttgctggattagcttgggtcagatatctacacctggcccaatcagaagtaggcaaataacaaattgtgctgtcctcccttttcctcaagctgtccagggcccaacactgtgaaatagggaccaattcgtagagaagacaggatccaggcaaggaccctaaagggcatctattacagtctttcagaaagtgtctccaattactttataaactcacctttcctttgctttgctttcctgaatgcacccagggatctatgagctactaaaatcaaccatgcttcactaggtcacagcagagggcttggttgtgatagaaaacaactaaaacgtgactgacattcattgagcacttgatttatacaacagatatatagatgacagatagataaatagatagatatgtagttttatcagataaatccagtgatgtaggttctattgcactcattttacagataaagaaactgaaggtttttttttttttcagttatgaaggctaggaattgaaccaagattttctagccctcaaccaagtttctatctacaacacccttttttttctttttcctctctccctccctttctttctcatcctctctgttcctctccctatatatgtatagtcatattaatgtgatagtcttacagatattcatatatatatatatatatatatatatatatatatatatatatatatatggacttagatacaattgtgtatgcttaacagttaggattttccgtattaggctcagagagaattggctaagttgaacatttagtaagtggaaatctttgacactgcagattaaactcaaatattttaattctatatctagtcctccttccatcgtatttctccatcaaactttttaatgcctcattatctgttgcttaatacgaagagaagaaaacccaccccatttttatatctgcaataatggctgaagaatttcttctatgtcttctctgggcaaagcatttgctgagcacttgatatggtattaccttcaaagaaactctgccagttacagggacattaagtaatttccccaaatccatacagcaaaaataagggcagagcaagccatctgccctgaaattccttgccctttccagttcaccaaattgcatctttgaagtcggatcaagatttgcgtacatatcctaccagtctaagcacgtttgaatgatggcacattgtctcactatattgaggcaactcttccttgcttggctgttactcataattaggaatacagttacatctttcactttggtccaatttttatcatatcaatgtactacccacctatatattttcttaatttatatttctttaaatcaacttattttttatgtctggccctagtaattatatccataaagtccaagacgtagtgaacttatttcataatttataagatgaattacaataaatatgtaaacattttaaaatgcatgtcttaaggaaatgtttgaatcaacatctaagaaaaattggtttgcccagtaagtcgcgtatttgtggggtcagctagcctgatccagcctttacagctccatgtagatttgctcttcttgactattgctgggtggtccccactgttctcacatagccaaataagttattccattacaaaattataactaattttttacagaatgaattatagattagggtgctctgcatgaatttgcagattcccaaagatctcaagatgtgtcaagaactccaagggatctttcacttcgtatttcaccgccgggtcaccctgggctccaggctatcttgagctgttttcacatcttctctgatggaacattttaaatgaggcaaattctgaatctgaaaatctttggtggcctttgcacatatcctcttcagttgtggaaaaaaaacatatccattgtatctgacttttcctttttcactctccttccattttactgtctgcttcattgaggaaatctttcatttagtggagtctagatttcttcctttgctaccatcttcatttcccaccaaataaatcaggtctcagcttatgatcatttgtcatctgctgcttcttctccgggaccgcccctaacagcctagcagagctctgggctgtattccatgatctcttttaattccttgttggcggcttgctggccctttctctttaccttcctgccaggtttaatgccttttagcgtgccagctctgtttttcacaatttttccaaaatgaggtggaaaatcaaatctctagctcctaattctcagtgggcaatattttcagagaatccttcaacatcattcactctctcaattcctcatcttctgagcttctccatccataaaacaatcagaaatgtcttcctcttaataacatagctcttctggtattggggagtggtgggactagaaaagagtagaggtgtaagcaatgcaatatgagttcattcatgcaaataaaaatcacactccctggacagaatccctctttcccgcagatctatctcttctagagagtatggacagatggaagaagtgagggtatgcagagctggcgtatggcagtcccagaacagggtcactatcaaaaagcaaatgccaaccatgtgatatataggactgctgggaatgtagtccatcattgctctatggtaaaaaagaataccttctctaacatgacattctctgaaccacatatagacatacacacatacaaaaataatctctaatcatgaccatcagtttttgcctgactgtctcagcatcctgttagctacgttcctgccctccatcttattccctgtgaatccatcttttatactgatgacatggtaacacttttttttttatactttaagttttagggtacacgtgctcattgcgcaggttagttacatatgtatacatgtgccatgctggtgcgctgcacccactaactcgtcatctagcattaggtatatctcccaatgctatccctcccccctccccccaccctaccacagtccccagagtgtgatattccccttcctgtgtccatgtgatctcattgttcaattcccacctatgagtgagaatatgcggtgtttggttgtttgttcttgcgatagtttactgagaatgatgatttccaatttcatccatgtccctacaaaggacaggaactcatcatattttatggctgcatagtattccatggtgtatatgtgccacattttcttaatccagtctatcattgttggacatttgggttggttccaagtctttgctattgtgaataatgctgcaataaacatacgtgtgcatgtgtcttttatgatgtaaactgaaccatgtcaatgtcccaccgaatagctcccacctatgactgaaatcagtgagcacttcacaaagagttttggatggttggcaagaggtatagtaggaaaagtagtagtgtgcttaaatcacacagccatgatgacaggtctcacattaacttcctgatcgctaacctaaaaaagccctcaatgctgcctggctatctgactactttactttagacttttcattcccctattctcacagccaactgattcttgttgtttctcacctccaatttcttacacctgtcccatcctcattctcagcttaaaacttgctgtgaaaatagaagcaatcagaagagaacttcctctagcttctaccactagagattttcatgtacctgtatctaaactcatacacccctcttgtttctcttaatatggactaactgaacccttttctgggaaagacccattcttcacctgtgcacaagactacatcccctttcacctgctctaagctccagctctcctcttatttcccctacgttatcactgtttttaatcaatatataaaaacagcattatcttttaaccatcatcatcattatcatcatcaaaacctcacttttctcattttccctccagctactgtttcaaacttctcaaaagagtttctatggccactctcttcaattcctttactccaaattacttttgaacatgattcaatctggctttcacctttgtactcataaaaatggctctctttaaagtcatcaacaacttctcagtccagatcttacctaaccagtggcagcatttgataaggttgaaggatccctcctggaaacacgttctgaatttggtttccatgacattaaactgtattagttttcctatttcttcccttgtttttcttcctgtctcccttgctcttcctcctcaaccctataagctcttaatgaagcagtaccccagggactacatttagactttccagtttgtctgcactcacactctcactggttttacccagtctcatggctttatgattaacactgacagctcccaaaagtatagctcctcttaggacctctctcctgccctccagactcatacatccaattgcctgcttggcaactctgttgggtatctcaaacttgtcaggttcaaaacagagctcccgatatttcttactcccaaatatgctccttctttactctccccccatttcaggacaggtgaagtcttataattagtgaggtcaaaaatgttagtatcatgattgtcttttcttttctcatgcttcacatctgatctatgagccagttctgtcaggactaccttagtagttttcagcatattcagaatccaaccactttcaccatcaccattgcctctgtgctgctctgagccttgttcatctcaagcttaaattattgcaatatctttccaggtggtctccctggaaagtcacaaccttgtaatctcctctctacacaagggccacagtgatcctgtgcaaacgcaaattggatgatatcactcctctggtccaatcttctcatgtctttcagtctcagagtaaaagccacgatcttgcaaaaacctacaaggccttgcaaaatctgccccccgccccccatctcttgtgttttattttctttcctattgctctttcctccattcattctgttccagctctttgcacagttccaagcatcctgcggccttggggcattcacaaaattgcttgctctatcttatcattcccccaatcccttacccatcccatatattcatggtttttctctcacctttaaattttacccaaatgtcatcttctcagtgcaattttatttaattgcagctctccctgttggaccccttcttgctccacatttgcttgtctccattgcacttaccactgcctacttgactcttgtcttagctcagattgccataccgaaataccatagactgcatggcttaaacaacaggaatttatttctcatagttctggatgttgggaagatcatgatatggactgattcagttcacccttatgggctctattcctgacttacagtcagccttctttttgctacgttctaacatggcagagagagagaatgctctggcctctcttcctcttcttataaagatgttaatcccattatgggagtcccaacttcatgacctcatttaattacctaattaccatccaaagtccccacctccaagtaccattccattgcaaattagggcatttttactgcaaaatttctcagtaactttagagaatgtcatgtatgcatctcctgggggaggtctgggcagataaaattcccaatgtttcacacatacatttgaccactgggttgtcagggaatcttttgggatgtatcctttagacccctgctagtcatgatgtggtttgtggaccagtgcaggttcacaaattatttattgattgtctgcaataagagaaatacagaaacggagagtcaatatttagaaaacgctataacaaattgacaatgctgccaagaatagtcatatggtttggctctgtgtctgcacccaaatctcacctcaaattgtaattctgacatgtcaaatgaggggcctgctgggaggtgaatgaatcatggaggtggtctctaatggtttagcaccattgccctagtgctgtgtcctgagttctcatgagatctggctgtttaaaagtgttcagcattccctgtgtctcgctctctctccactgctccaccatgggaagatgtgccttgcttctccttcaccttctgccatgattgtaagtttcctgaggcctccccagccatgcaaactgtgagtcaattaaacccattttcttcttaaattacccagtctcgggtagttctttaaagcagtgcgaaaatggactaatacaaatatgaacagtagcttgtgaagtttttttttttcacacttcatttttctagtaattcatctttattgtgttttacaaaagtatcagttcatggcagatttaaagtaataagaagaaaaatctttcacttactgcagataatttgggaagcacctcctccaggcagattttaggaaatattggttaaattccaaaggtagaaaaaaatctcttgtaagtccagtctctagactttttcctaacattcccagctgcaccttgtatgccaactgagtcaacttgctcctctaagccctacgtgtgtccgggctgttcatctgcttgccatgtctttcctgcctcacatgcctgatgcacattttatccttcagaatttggttaagaggttaatggtgctagaaagagtccccagattcctctccataaacttgatgacctcactttacctccacgactttctggtaatcttatcctcaaatcagtgctccactgttgtttttgtttagattttatttttaattgacacaaaataattgttcatatttataaagtacaatgtttcaatatatgtatataatgcatgatgatcaaattagagtaattagaatatctatcacctcaatcacttatcatttctttgtggtaagaccattcaaaatcctttattctagctgttttgaaataaacaatacattcttattaactataatcaccctactgtgcaatagaacaccagatcttattccttctaagtaaccgtaactttctccccatgaaccattttctacccattccccttcccccatgtatttgtgtgttttcaccctgctgataaagatatacccaagactgggaaatttacaaaagaaaaaggtttaattggacttacagttcctcattgctggggaagcctcacaatcactgcggaaggcaagggggagcaagtcacgtcttacgtggatggcggcaggcaaagagcttctgcaggaaaactccctcttataataaccatcagatctcatgagacttactcactatcaccagagaagaatgggaaagacctgcccccatgattcaattacctcccacctggtccctcccacaacacacgggaattcaagataagattttggtgggtacacagccaaaccatatcatcaactactcttcccagcccatggtagccactattcaattctctacatcagtgagatcaacgactttagattctgcatatgagtgagattatgcagtatttgtctttctgtgttaggtttatttcagttaacataatgtcttccaggttcatttatattgtcacaaatgatataggattttattctttatggctaaatagtattccattgtgtgtgtgtgtgtgtgtgtgtgtgtgtgtgtgtgtgtgtatgtgtgtctatgtgtgtttgtataccatatatatgccacattttatttattcatttatttattcattttatttatccatttatttattcattttatttatccataaatgttaatgaacatttaggttgattccataacttgactattgtgaatagtgttgcaacaaacatgagagtgagacatctccttgacatactgatttcatttcctttggatatatatccagcagtgggattgctggatcataaggtagtcccagttttaattttttgagaaatctccatattgtttttcataatggctaaactaatttacattctcaccaacagtatttaagggtacccttttctccacatccttcccaacacttgttatcttttgtatttttgatagaagtcattctaactggagtaaggtaatacctcattgtgttttgatttgcatttccatgatgattagtgatgttaaatatttttttcatatacctctttgtcatttgaatgtctttttttgagaaatgtctagtcaggtctttcgcctatttttaaaccagattatttgtgtttttgtgattgagttgtttgagttctcttttctctccaacttcatacctcatccctgggcaaccattaatctagtttctgtctctatagatttctgtattctggacattcatataaatggaatcataaaagatgtggtcttttgtgtttggtttctttcacttagtataatatttttcaaggttcaacaatgttgtagcatgtattcgtactttattcctttttattgccagtgtttgctagtattttattgagaaattttgtgtctacatttataagagatactgctctctagttttcttttcttgtgctgtttttacctggttttggcataaggataatgctagctcctagaatgggtttggaaatattcctttgtcttctcttttttgaaagagtttgtaaagaattattactaattcttctttaaatgtttaatcgaattcaccagcaaagccatctggaattgggctttaagttgtgggaaatgttttcgtttgaaattaaatcattttacttgtaataagtttattcagattttctatttcactttgaatcaatggtggttgtttctggttgtctttctagaaatttgtcatgtcatctaagctacctaatttgttggcacacaaatgttcacagcattcctatatgatccttttttatttctgtaaggttggtagtgatgtctccactcccatttttgattttatcaacttataccttctttcctttcttcttcagtctagctaaaattttgtcaattttaatttttttcttaaagaaccaattagaattgattgattttttgtttttctatttcctattttatttatttctgttctaatatttactattttcttccttctgattgttttgcatttagtttgctcttctttttatagttttttaagttgtcaggttagattattgacttgagatgttattatatagacatttgtagttataaatttctctgtaagtactgtgtaagctacattctataatttttcgtatgttttatcttcattttcatttctctcatagcattttctaatctttctggcatttttcagaccattgattactcaagagtgtgttgcttaatttccacataattgtgaatttctaaatttccttctgttactgatttctcatttcattccactgtggttggagaccatactttgtataattttttaaaaatttattcagacttgttttatgccctagcatataatctatcctggggaatgttccatatgtacttgaaaagagtatatattctgctgtttttttctatcacgcctagttggtgtctatcacatctatttggtgtatactgttgttcaaagaaatagaggacttgagcaacgctatacaccagatagacctgacagacatttacacaatgttccataccaaagcagcagaaatacttgactagttgttcagaatttatttttaattttaataaatatatttcaatgcatccatctcacttactcatttctcataaaagtaatatgagtaacacccctctacgaccatggaaaaagtggctatttttgattcctctgattcaatagatcactgtagaacatgaagtcaccaaatattcttgtgtaagagctctctgaaaattaatcttgacaggattgttgggggattactggcacaggtgtagactgccaggctgtctctcctgctttgcacatagccttttttgagtataaatagaagaagaacattactgctttctgctatttcaggaaagaacacacccatttatttagtcattcataagcactgagttgaatgcctactgtaagacaagccctaagagtacttatagtaaacatacacttgattctactatgacataaaatccagaatctgatggccaatcctactgacagcagctaagagtaagaacttgacatgctcagcaggtacataagatatactttccagatcaatgctggattatgaatgctttctgtccacaggattctctacatgctcctttccttacctccatcaatttctgatgtgggcaagaaggattgttgtacccaataactgagtctacaaactcaactctcttcattatgtctagggcaatgcccagtgtcctaagaccaccagttgcaacctcctacaataaccccattacattggctaattttgttgatatatctgaatacatacatatctgactataaaacatgactctgaaacttactagatattggacattgacttgttcgcctaacttctccaagctttctcagtcttttaatttggagaccaggcatgaaaaatatttatttcacagaattgtagtgagggttaaatatttaagataaggtacctgacacatagtgggcactctccaagagtggtagcttaaaacatgcaaataacaattcttggctccttattctgtgctctggacttacatgtgagttctcagctaggagttaaggctcattctgaaactaagctagtgacctggtccttcatgtgctccagcacctgcaaacaacgtgtatactcttccctggagcaagaacaccaaagaagtgaggtggagtgcttccttcttttagtcctctagttgtcagctggaatactgactgctatgaatgaactgaccacctggtactatgcttctggtggtcattatcatccagcccttacaacacacaagttcactatgctctacccactacccctagagatcaggatcattgtcctcaggcctgtcctgcctagttcttttgcttcctccttttcccatttgttcagggtattaaaatcccaaaaccctgcaagactctgcccagtcaaattatgaacactaaacaccgaactccaaagtctaacccacaatgtttatagtatgctgtggatacatctgacttatattaagacacttcagggaacttatgtgactcaacactcaatgctgaccaagatggccccctaatctaggccagatggcaaactgatcattaacttcattctgatggacttgttttccccaaaatgagctgttataattaatcctctgttatctggcattttatcaacaaatatcattcattaactaacattttccctgccagttcaactacaattaattatcacaatgataagctgtggcactaagggattctgaaatcatctcaggattcagagagtgacagaaagagaataagagagagaatgagagacagcaagagagagaggtcaaatcatgctcagtagaattttaatattaagggtataaagcattgcttctgcagtgtcctggaaaccccatcccatttatacaaatgccccagataacgtctcctaatggggctgtcatgtaatatatagaaaatcaacatactttagagttggctgaatttcttcagcaagcatggcctcatccccaccctacaatcgcagtaccccatccctggcataggtcaagtccatagaggtgaagcaaatctatctaatcctggcagagacaatatatcactcagtatcattgtatttaccatcctacactttaaaagaaaacaaactccttaccctgatcctacagcttttcagaatgattaaaaatcttttctgaaatatgtcatggccagaatctcaatgaaaaaaatgtgacaaaccaaaaccaaaccaaaccaaaccaaaacaaacacacacacacacacacacacacacacacacacacacacacacaaaacagaacataataaaacaaactggatacaacaacttttcttctgggttttggaattaatttttacttcttaaggattgttaacttcagcaatgggatgagtgccccatttggtacatggtaggcattgaaggcattttggtttgtttgtataacaagagttaataaaaaaatgtaggtttcctgcagccaacttccaaaaatatataataaatatttgaatgatacgtgtttccaagttggaagcggtctgtttttctggatttgagtctgttgtaggagctacacgcagcctgcctcattgctcacaacactacaccacaactgtgtggttgacgctggaactgtggcaatggagccacttgagggctacggggttaggcagagtaaatgaaccggcctcaaaaccaaggccgtctccctctgcaaaaagataaaaggaaggaagcaacaaaaggtggatatcttcataaaaacattctcagatagagcatctcatgtaattcacagcagacacgccaagacatgataagattcttgttattgggattttaatgatcccagagtcctgctgcgtcagtgtcctgtcatatcagctctgtggcttttggaaaaaaagagcatggtgttttctgaaagtcggaaggccattgtgactcatttctgagactctctcccacttaggtatatcaaataggtatgctgctttgatcaggttaaatttttaaagcccaagggcactgaggatgtggccatgttaataatgcagagccgcaaaaactttaggaaatatcctgttatcccatcagtgtgggcagcaagccttgggtagcaccagcaaaccctgagagatcctgccagatggaaagctggcactgatgggaacaaattctgccccagaggatcttctttgagagtaacccttagggcaaatggatcactctgcaaaaagcttactggagaaatataggggtaggtaatcacatgtttgatttcttgcaatccaggttccaagctcaagaaaacctattcccagatataaagtcaaaaagagagaataaagccaaaaactaggatgaaggagaatgatcacatagttactaaaagaattaaaatgtacaaggaaagacaataaacatcagaaaggaagaagaagagaataaatgtgtgaaaaagacctgagatcaggcccttgattagcagggagaaaagaatctgaacaaggcaagtaagggaacccctactgcaaggtactgcctcggtaccggagcacagcaggcaagaaagactgctcgcaatctccaaagaaaacatttcagaacaagagaaaatgaggtaagttgtgctttcatcgcttgcattacgcggcggacccaagttcgcttgaatggtaaacgagcgatgatttgtaataaacggtttaggctgtggggttggctcttcagtcctaacacagtcccactctctggggacgagtcatactagtggccacatgccttataggatttggtgtcacccagagaaagagaaaaaaatctaagacaagcatctctcattgtcactattaataggaacttagagactgatttttggatcacttgctcttaaactgtattcagatgttgtgaaactggctggctgacaaatctaatcaaattaactccaccttaaagcaaaaccctgtttcgcttttttgctagcgcacttttttaattattcaagcaaaacagctttcttattcaatttgaaatctgtatttgtgcacaagtttgtctcacattgctcaacatcatctattaactgtttacacacagcagtgattctccaaaactatttttgatcttctaaacacatatttaaaacacatacaaacagaagaaaacactctgaaataaaatacactttattctattatattattatatacactattttatttatttatgttattattatttttctttgagacagggtctcactctgtctcccaggctgggatgaagtggtgcaatcgtgtctcactatagccttaacctcctaggctcaagtgctcctcccatctcagcctcccaagtagctgggactacaagcacgtgccaccatgcctggctattttcttcccccaccatattacccaggtttgtctcaaactcctgggctccagtgatctgccagccttggcctcccaacatgttaggattataggtatgagccaccgcacctggccaatatacattatttttatcataaccaatcctccctttttaaaatttcctctgagacttcttcccaagttaatcatcaattactacagagtaaattttttcaaggggaaaaaagtccttctatttcaaatatactatgaaataatatcttcatcttaaaaacatgattacaagcatcttttaaaatattatcctttcctttcaatgaaaacgttttgtacaaataacttgggaaacaaaaatgcttttcctggtcaagtagggatttttttcagacagctcctctgctgccctctaaagttcaagaaaaacataacagctctactttgcagacagcattttttttccactgaaataccaggattctctaaacttcaaagataattggactcattagtctctgctctcaatacagtgtggccaggcacgtctgctcaaagtgtacatgtgataataccgaaattaaaaaaaagcttaaagggcaggtgttgatggtatttttaatgccattgctactaaatgtgtccctatgattcatgtgttactacacaacataatcatgtaaatagccagaattttatgtttggaaaataatccataacttttgggatgttcataatttgtgttttgcgcttttctgttaactacgccacaattgtggccgaaatataataaaaatgaggacagtaggcataatattgggactgtctgctaagaaataatacataaagctatgactcagaaagtgatgtatgttgcttcctgaactcacccactttaatgacagagccagggccttgacatcgggacagattattagaacgtgaaggttggtactgccggttcagagaaaggaggcaagagattagcaaaaagcaggctgtataatgactagtctggagtggagaagggagggagattagctcctttctgttctttatgttagggacaaggcagagagcaaaagaagaaaagaggaaaggagaaagggaagaaaggaaagagagaagcaagaggcagggaagaaaatgcaatatagaatattcattgagcctcttctttgaactaagtactttaacttgttcacaataatcttgtaacatgctactctctgttctacagatgagaaaattgaacttcaggaaaaatagataatgtggtttagttgtacaggttgtgtacagtgcagccaagtgcagaaaggaaaggcaaatgcactagacattgcttcctctgcacttctctatgctttaaccaaataaccttctgagttccagctagggagctggcaggagagatgaagaagcatatgaaaaaataaagagaggcacacagtcacagacaagaaggaggattaagggtaattacaaccccaaagagcttgtggtgactcactaaaaagccacagggagaagcagttagttacaagagaattcttggccaaacgcccaattcaagggccagctgttgataatttaacaaaaaaaaaaaagtcctctttgaaaacctaaaatcattagagaagtacttttcacttcagctctgcatcagcagttagtttggatcagcagccaggatggggcattaatgctttaggtagagggggtctcaaaatatggctcttggatcagcagcatcagcatcttctagggattggtataaacataaattctcaatgctctccctacctccaggctcacaaaataggcatatctaggggtggggtctagaaatctctgttttaacaaggcttgcaggagattgtggtgcatgcttaaatttgagaactaggtttgtataagtcctttaatttgtttggcaagtactctctgtggcttttactatcaaggcaagtttgagaagttctgtttttaggaattgaggaaaaacttttgccctaggcccactgaaaaatgcttccttcctctggagaaagcgatagtaattcagattctcttccctcatttcagctgtggattcattgaaattagggcagtagagtactaattcccagagtcctaataaatttgacttcctacttctgggtggaggaacagaattgggagagttgcagaagctagggaattaagagaataataattagcaaattttatcggaatctttatctctgtatttcagttctagaaattgagtattttatatattttatcatgattatataaatggagctaaatgagtttcctgaaatttacattttatgcacagaaaacaggctctgccaatatttatatgttctagttcctatagattgtagagaaaggggaatgagacagtaaacaatgggcttaatttccttttcaacagggcttcataattcagtatcaatcttgtggaacagatattcccatttcacaggtgaggaaactgagtcttctctggctacctactcagctatgggcaagattcaaaaagaattcctccatccctggattttaaattcaaatgagaggacctatggtatccctttggggtcagaaaatacatcatactttattttatgtccctaataatatctggtaaaacatctgacaaaccatttaatcgatttctaaataaaaatattcttctttctttttattggttgcatttggagaaagaaaacaaatacttcatgaactgaaatgtatctgcatcttttcttggcatgaattcactttctactttgtatcatcacaaagatgacaatgtcccatgtggcagaggtgccttgaagttaaccagaaattcctgaagctttttccataatgtagagttgttgctgggaatggctgcccagtcagggactacattcctaggcatctttcctagggatctataacaaattcttgttaatggaatgagagtagacacaatgtgtgtcacatttagggtggagcagataagaagcaagcattacctccatttcccaatccactgagtgcagaggaccccgagatcgtaggagatggtagagcaaatagggggatagaacctggaatcctgaaccatgagagagaggaaagtctccagtccccccagagtgctcacaacatgagtgagaaaaccaatttcattatgttaattggctgaaatgtgtgtgtgggggggttaatattactacaactatcattaccttaatcagtgcatttcatttcttctcttagattatcatgttttatgttagatgatgaggtttttgagggtagtttccatgtttggaaaaatatggattatatagctgaatcaggagctgggtttttcactcatgagttttgaggaaactggtgttttttcttccccttggcttctcttcaaggagatactgattacaataagttgactatttgaaacgcagttcaggttatcggtaaaatctaggctatgcagtcagctagatctgtattcaatccttggtttttctctaattaaatgtatgaacatactcaaactgcccagtttttctcctcttctgcaaaatgagtgttaaaaatccctatattctaagattattatgaagatgagagttaatatttataaatgcctagtatagtgcctggctcatagctagcattagccactggtggtagacttctaaaaatatgtcctctacttttcaggagagaaatatactatgtcaaagccatcaggtttggtcatgtgatttaacttggtcaacaacgtgtaagcagaaaagatgtgtcacttgcaagttgaacctgatctctttctttctgacatgatgattggcaacgtttcgttagaaattgctccattatactggatatcgaaatgaagatgacttggagcaaagccacaattaccctacaatagggcaaatgttacttttgctgctgtaagacattaggatttggggaccatttgttactgcagcataacccaacttttctgaaaaatacataaaatatatatttctcagtcagggaatacggggaaatcctttaaactgtcaaattctctatcgggaactggggcatctagccctttccctgtccctcccaccttgcctcctaagaatgactaataataaaaacagcataggctttgtccttgctccccttcctggagaggctgtaaaactctacaaaatacagaaaatgaaatattttctgatggtaaaagagtttttttaaaaaatctgaagacagaatcagatctccatgctgtcctttgggagttcagattttagaaaaagaaattggagctttacatacatttaacatacatcatttaattagagtatatatcttcagtgagcacaagaaaactttagataagagtttcatactttgtagtgaagcaaagttagtattggagaagtcttgtggggagcaacacagaagactgagaattcttttttttttttttttaagacagagtcttactctgttgcctgggctgaagtgcagtggcgcagtcgtggcttactggaacttatgactcctgggttcaagcgattctcctgcctcagcctccccaagagctgagactacagacaggtgccactatgcctggctaatttttgtatttttagtagggatcaggttccaccatgttggccaggctgtcctcaaactcctgacctcagatgattcacccgcctcagcctcccaaagtgctgacattacaggcgtgagccaccactcccggcccaggcaacttaacagagctgaattcttaacagggctgagaatttttaacagggctgtggagtaacagaacttgatggaaaattggcatctgtgtagaatgattctaaagctttcagacaaatggcagaatcctagggtaaaaatatcacctttattttctttcatgaactctatcagtggaatatatttagctgaatttctacttaagagcaggcaagacgaaaaaaatgaaggccactgagaattgtgtcaattactctaacttttctgttattattattattgaaactgccacagtgcacctagcaatttgctgctctatggtcctattaatccagagtctgcagatgaaaaaagcaatgtttttatgctgactttactataatcacagtgaaacaaaaaacgatcaattcattgaactccaaatatgcctcaggttatgatcttactttatcggacattctttgtaacactgaagagatatttcaaaactataaattgtgaaagtctccctactctcccttccacagtggctaagacatcttaaaaagaaagcctttccccaaagcattatctatagtgatcatacctttctgcagaagctgtcccaggtcaggtaaggaaaaaggaaggggcagaacagaaaggagggagagacttcacatgaggaggaaacaagcacattaaaaataattaaaatcggccaggcgcggtggctcacgcctgtaatcccagcgctttgggatgccgaggtgggctgatcacaaggtcagcagtttgagaccagcctggccaacatggtgaaacccagtctctactaaaaataataaaaaaaaaattagccaggcatggtagcaggcgcctgtaatatcagctacttaggaggctgaggcaggacaatcgcttgaacctgggaggcggaggttgcagtgagccgagactgcaccactgcactccagcctggacaaaagaatgagactccatctcgaaaaacaaaaaaaaaagacgttaataaaataaattaattaattaaaataaaaataattataatcaatgctttgttctatgttgcctaccttatattctttacagtttttgttcatactctctcctaacatatttttattaggagtttaacaggccaatatattctttctaaaatactgttaaaagacacacaggagaatatatatatctctacttttatgtaaatcagctttaccattttctaagtgtttacacattagagttgcactttactcccaaaggtacactgagttgtatccagattgatgctaattatcatcttacagatgaaactggggcttagagaagatgtgacagaagtgaaagcggagcccagaccaccgtaccacagctcattccacatggaaatgcctttacctacctatgaactgatactcagagcctggcaacaactttcaaccctccactcaccgacttttccaaataaaagcaagttacgggtcaaaatgttgtcatttgacattaaccattatttaaccaatgtccctataatcaagagacacttagagcatatatttaatgttgatcacccttggcacactgttcaaagaccagttcaggatgatgaaaatcaagttctcattttcaggccttacaaaactatactctggaacagtcctcgaaatgcaaatttggctatatcgcagctacagagatgaaagctttgtgaaactctgatattctagttaaagactattcatatccatttctagagtgacttctgattttgacatataaaaatatgttcatatttttcacccattctggatgatgcaaaatctagctggtataaccatgttatttaatttttaatttccgcaaacctcactttaaaatgcataaaccattctatcatgaagagcacctttttttccaatgcgctgttattaaattcttattcctgcagtgccttctcacagactagttttctacaaaagaaaaaaataaactcattgcttttcatatgaagacccagggttctgccttctagattaattacatttgattcaaaggtggctctctgtaagtaaatatctctagctcagaagcaaaaggaagggttcacttcaggtgtttttatcttcgctcaagagtcaaaataccttctgcattttatataggtaaagctagaagaaaagtaatctatacttatacctatacttacctgtctatctatctatctattgagtttttcattatgctgctgaaactagcataagaaaatttgctatctctgctatgaattaaatgttgtccctcgaatatcatatgttgaagccgtaacctccaatgtgactaaatgtggagttagggcttttaggagacaagtaagtttaaattaggttataaagatggggccataatctcatagaactttggcctcataagaagaggaagatgtttctcccctaaggccccatgtgaggatttagtgaaaaggtggctgtctgcaagcaggatgagccctcaccagttggccagcaccttgatcttggacttacaccgtccagaactgtgagaatataaatttctgttatttgagccacctagcctgtggtatttctttacggcaacccaataaatccctattttaaatattaagactccaaatctcaaagacaagttaatatgagtctatgtgctaaacctagaaaacctcaaatctgagttgttaaccagacgctgtgatattcatgtttctttttgttaggcttcagcatcttcctttgggggccaaaataattgtgtgtgtcccttttcttaagtgaaatctgtccctaaaatgtagagcactgtcttctttgtgctccagggttttcttccttttctccttggctccgtccttgcttacctcctttaacaaatccaggcaggactctgtcctgggcactgtcctaggtgctgaagatgcaacagtgacccaaatatggtccctgaccttaaggagtgtcctaagagactgcttgttaccagcggtttctcgcttcaagaaggtttcctgaataaattttaaaaatcaatgtgtgttgttaaaagctcagtgttacagttctgatccatgggttgagttataatgaattagagttccacaatttatgttgaccatattcccaaagccaattattcttcagtttttctattcaggttttttcttttgcaaacaaccatcttggctaaactttatgcagctccctagggcaactttgcattgccaaggtatttctcaggattgtgcctgacagacaccgaagcttagtgtctgaagcaaacttaatgagctcattttatagtctctcctctaggtcttgataaaaatattaaacccaaggaccaagactgaatacctttgaatatcactgtcttttctggattctgaagttaaaaatagccagtttctcagtagaacaccctagtcaacagcatatcaattaatctgtgtattatgggggccacaactccacagcttactgataagcgtatcatgggggcaaaatcagtagccttgccatggacaaaggtgaatatatatataactaactttccttgactctccaaactttttcatttaagagagcaataaatgaagatgtgctacttgaaaaatcattatgctagttctcaccaggctccctcaaaatatttatgaatgggtgttataattaatttcttatgagtgcaccatgtacagaaggtgcctaattctctgcaaaagcaagtcccattggggacttattctcccagctccaagccagtctgaagcattccccaagtgtcagaataacagtagggtattttagccaaaggaacacaagcctggtggtattttcttgctgatttattataactttcattcaccttttattctcttatttttctcttattgaaacgttgttataaaacaaacccatgaacaaaaatctatcttcaatgtatctagcctgttagtgtcaacctctcaacatatcctcctacccttcaacaaatattctgttcttatttattggaataacctttgttcttctttttgtatattgcattttattttattttttaaaaaatctttacttctatttgatatgttttggacttttcctttcttaatctggttaatttcccaatgttgaaccatttcaaattaacactgaaagatacagaaccctaggctctttttactatttatttacatatttatttatttatttatgtgttatttcttaggtagcatttgtctcaatggagatttcatgtccccctttaacctaggacttgggccttttgaaatctaaaaattttccttagtgccttctaaagtcataatactacacattctatatcatgcaaaacccacaagtatctacaaggcagtaaggttctttttaatggggtgggggaaatagcaaacaaaacaaaactgcagcaatcaaatgtttagcattaagatgttttccaaattgttgaagaagtgctgaagaaaacgttttggcgctccccagatggcagccattctgactccaaatgttaccgttattttggccctcataggaagtactttccccgtaagaccttgattcagtgattgaccttggttttgataatgtctcattcccttttagattaggaaagtccaagagaaagcaagacggggaatgcactaatgataagcagtataaatttcggaataggtttctcatcttttctagtgtgattatagggtttctagattcaatctggatcccttatacagttctgatggagagcattttactagtatgttctttacaatttgatcatctggatggcaatatcatatacagaaaagagaattggatttcagagctaggtaacttgggttaaaattccaacattttcacttactttgctgttttctaattttaaaatgaagggtagacagtccttttattacttcatcatttccacaaatacatacagactataacatgccaatcacttttttcaggttcagtaggtgaactttaaggtctcttattatttctctgtataaactgttcagctagacctctgggcttatatgtaagcttccgtgattcaaagcaaaccaaaatgtgggccagcccagtatctgcagggcataagtctgccagaagacacctactatcaccaactccttgtactttagattgtctagtctcatcctgctgctgctcaaaaagaacaaaacataaagcaaaatggaaaatattttaaaataaggtataaaatgtaataaataatgaggaaagctaaaaacaatttatttagcactggccatttatttgcataactctgtgggaaagtgaataagtgatgtagtttttattctctaatagcaaagctcacatggaatgagatatgcatgctaaaggagtgtacacggcatgattaaggctataaagctgtatggtttaaggagagaggaccacatgaacaaagggtggcttcaagaagaaagatagtgcttaggccagtttacaagtactttataagcttgctctttacaacatgcacatacacacacatacaggtaatctcaacatcattgtcatacaaaacaaaaatcaggtaaaataaaaaagcattaaatgggtggcaattatttcacagtgaaacatagtttcacacgtattcttaggaaaaaaaacattgaaaataaaccaaatcttcaaattaatagcagagaaaatatgcacaaaataaataaaatttttaaggatagatacaaactagtaaaatatacaataaaactcagaaaagttcaacaatttaaaaagccagttatttgaaattatcaataacaaaaatgaatagttttaggcacgagaatcatttaagaagtgagaatattaggaatgagaaaccaagataaataatattaggaatatgattgtatgttaaaacttagaaagacacaaaagagattttattatttttataataatatataaatttaacagtttaaatttgaaagcagatgaatttcataggaaaatttaaattaatcacattgactaagaagtttagaaaacctacataaatactgtataagaaattttaaaactggtcataaattcataacctattgcatcctaaaaagtcaaataaaattgttttatgataaaatgaaaccaaatttccaaaaactagctattccttacattattgaacaaacagaaagatgaacagattcccaattcatgtaattgtacaaactaatcctaactttgatactataaaacaaacaaataaaacagacaagactagttagaacaacaataacaaagtgaaaacacgaatcttttgtcaatagacaaacagaacaaattatactgggcttataaggaatctccttaacttgataaagagtaattaagagaaccttatcaaaacatcatactttataatgatgattcatgagaagcagtcagtttcactaatatgacaagaatactcacttgcatcaagcaaagcaaacataaaatttagaaacaatgagacagttgaataaagtggtaaggcacaaaataatcattgagaatctataactttgtatacctcagcaatagccatacagaaaatataccaaatattcagtttataataatggcaaaatctataaaacacatagaatatgtctagttaaaattattaaagactcatatgtagaaactgtaaaacataaatggagaacataaaagaaaacctaaataaatgaaaatacataaatattcctggtgcaggatattcaatattgtagagatgtgacttagttcttcatccaaaaaatttataaatatttaacagtgccaaacaaaatcccaaaggatgttcttttattgcacacagcatggccacttaaaacagggtgatagaataaaggcaggagaaaagcaaaagaaattaaacagaaatatgaaaggagaccagtactgccagatatcaaaaccatagttaggcactgatataggtgtagataattcaatcactggaacaggctagagagttcctaaataacacaacggttatctggaaagttgaaattagtataggaagtagaaactactcaataagtgtcccaagaaaaactggctattcaaatgaaatttaaaaacaaatcctgcagtgagttcaagggttttgggggactaaccaaggaaaaagatatgaccacaaggtagtaatagaacacaataaggtctatttgagcagtgctttgacaggtttacaggaaaaggtgagtccctcacaacatgagaactttcagaggcaatgctgcaggaatcactgtccaaaacagaaaggaaggaaaggggacgcctggagaagacccttccaggaccagagagggggcttaactaaatacatgaaggtggggacgctctgggtcagagaattctgaagggtcatagtggcttgggatctctcatagccctggagtttatcttatccatgtctaacagatgtttggtgcagtttcgtgtgatatgcaaaacaagcagctctaaatggctaaaaatgtgcttaatggggttatgtttaaaacaattgaatgtgttaaaaatttgagcttggcactggtgggcttctggactaatggattccagcctactgcgaagaagggaaaaacacacggcaggtccactatacggggccacttgtggctcattgaaataacaaagccttacctcacttttctttgcatgcctatctgcttatgcacacatctcagatgtattagaggtaaacatgaaaaaataatgtgagaaatgtaggaaattacatttataatattagggtgataaaggctaaatctaaaagtcacacatttatgaaataaaaggtctcccattattattgtgtgggagtctaagtctctttgtaggtctctaaggacttgctttatgaatctgggtgctcctgtattgggtgcatatatatttaggatagttagctcttcttgtcgaattgatccctttaccattatgtaatggccttctttgtctcttttgatctttgttggtttaaagtctgttttatcagagactaggattgcaacccctgccttttttttgttttccatttgcttggtagatcttcctccatccctttattttgagcctacgtgtgtctctgcacgtgagatgggtttcctgaatatagcacactgatgagtcttgactctttatccaatttgccagtctgtgtcttttaattggagcatttagcccatttacatttaaggttaatattgttatgtgtgaatttgatcctgtcattatgatattagcaggttattttgctcgttagttgatgcagtttcttcctagccttgatggtctttacaatttggcatgtttttgcagtgcctggtaccggttgttcctttccatgtttagtgcttccttcaggagctcttgtagggcaggcctggtggtgacaaactctctcagcatttgcttgtctgtaaagtattttatttctccttcacttatgaagtttagtttggctgcatatgaaattctggggtgaaaatccttttctttaagaatgttgaatattggcccccactctcttctggcttgtagagtttctgctgagagatcagctgttagtctgatgggcttccctttgtgggtaacccgacctttctctctggctacccttaacattttttccttcatttcaactttggtgaatctgacaattatgtgtcttggagttgctcttctcgaggagtatctttgtggcatcctctatatttcctgaatttgaatgttggcctgacttgctagatataatgtggcacatatacgccatagaatactatgcagccataaaaaatgatgagttcatgtcctttgtagggacatggatgaagctggaaaccatcattctcagcaaagtatagcaaggacaaaaaaacaaacaccgcataggtgggaattgaacaatgagaacacttggacacaggaaggggaacatcacacactggggcctgttgtggggtgggggaggggggagggatagcattaggagatatacctaatgtaaatgatgagttaatgggtgcagcacaccaacatggcacatgtatacatatgtaacaaacctgcatgttgtgcacatgtaccctacaacttaaagtataatttaaatatatatatatataaagaaataaaaggttgaacttgatgacataaaatgtttaaaattcttcatcaaattaataataagaactgacgtttgttaatatggtttggatctgtgttcccacctaaaactcaggttgaaatgtagtccctgatgctacaggtggggcctggtgggaggtgattgaatcatggggggagtttccaacgatttagtaccatccctctagtcctgttctcacgatagagttctcatgagatctggttgtttaaaagtgtgtgggccgggcgtggtggtgcacgcctgtaatcccagcactttgggaggctgaagcaagcagatcatgaggtcagaagatagagatcattctggctaatatggtgaaaccccatctctactaaaaataaaaaaaaattagccaggtgtggtggcacgcacctgtaatcccagctacttgggaggctgaggcaggagaatcccttgaacctgggaggtggaggttgcagtgagccgagatcatgccactgcactccagcctgggcgaaagagacagactccatctcaaaaataaaaataaaaataaaaataaaaataaaaataaaaatgtgtgtggtacctcccctgtctctctcttcctcctgtgctggccatgtaagatgtgcctgcttcctctcaatcttccaccatgattgaaagtttcctgaggcctcccaggaagctgagtagatgccagcatcatgcttcctgtacagcctgcagaaccatgagccaattaaaccttttttttttttatagattacccagttgcaggtatttctttgtagcagcgtgataatggactaataaatttggatagcatttataataatgcttatgtatattgaatcatgtaattttcactatgatttatgagaaaggggctgggtgtggtggctcacgcctgtaatcccagcactttgggaggctgaggtgggcagatcgcctgaggtcaggagttcaagaccagcttgactaacatggtgaaaccccacctctagtacaaatacaaaaattagccaggtgtggtggcatgcacctgcaatcccagctactcaggaggctgaggcaggagaatcgattgaacctgggaggtggaggttgcagtgaggcgagatcacgccattgcactccagcctgggtgacaagagcgaaactccgtcacaataaaaaaaaaattaaaagataggtagttattctcatttgactgttaattacataactcattaaatgtatcaccacgactaaaataatatgcagaagtgtcatataatgttgtgcaggttataggcatacactgtgcaacctgacatctgtgagtaggggttgagggttgtttggtcgggggtcattcccgcagcctttgatgctacagaaatgccctcactcatctacctcattgtttatatgtttagcattcaagaaaatccaagggccactttctctagaaagtctgtcctggcccaacttggcacatacaacaaggtaaaactgacctctttcttctccaatggcccattgttctttccacaaactactctcacaggaactttaacattttgtcttgcttatttatttactcatctgactccttcaccagattgcaggctacttgagggcaggaactcttcttatttgtctttgcataaatgtttcccagcataggtcacacacatagtgttgaataatttttcgttgaataaataccaaggtccagagagatattctactgaatggcaatttgcaagatattgattttctttgctcccatttggtgatattgttaaacttttactggagggcaaaattcatagttgtcgcttcacatgtgaattagcaaggaggcaatctcagctctaaaatctttacacttatcctaacacccccatcagctcacactattaaacattatagataaatactgcaacattaagttttgtggcagtgcaaataaaagcagtaacaagttatgtaattataccactcttttttaaaaaaattattaaatgctaacacttctccaattataaccattcaattactactcactgcctaatgtccaaaattcttaacatgtcctagaatggtctctaaaacctggctcttgtctatgtctctaaatttatctcctgctagcccctcctactccccactcccatccatgccacagcatacatgtgccctatattcagataacattttgcaaattgaaattgcaagttgcaattgccctaatccaatctcaactctttaaatcatctcacaattttacgctctggcatattctgccacttcagctcagaatacccttttcacttttgtagcacttcaagctgtcattcataattcaagtctcagcttaaaagccacatcatatcctcaatgaaacctcctcgcccagccctagcagaatcatgggatccttgctgaaaacttctagggttcaaggtgcacaacttgtatccacagtgtttaacacaatattgtatttgtcattgtttatcacatttctcatctatcttccacctttttgaaagcaaggattgagtttggcttattcctgaatccctaatgtctaacgaacgaccgtcataaagtagccacttcaccaaggagggatgaagcagcaaacaggaaagcctggttcaggcccatctttaatcactagttttgtgaaaaagttcactgctgcttcccacagcctgggatttggttttgacatgattatttttcttttgcagcataggaaggaagctcatgagaagaattttagaaaaatcaacctcgatttttcccatggctgtgcctcacctagcagactatctcaggacagcttcctggaaacacagcagcagaaagtaagctgcatttatttacttttttaaaaatgtgttctgatactttttgattattacaaagaatcttgctgggtgatactgcagtggactgacctgatatatgtttccttcttttttcagtgaattgttcagttcttttttggaatactgtgggtgagagcttcaggcagcacagagccttagaagtatgctttgggcttggattgggacacggatttagtaattccacaactcaaaagcaacttctgagataaaagctgaatttgtaaatatgtgagataccctgaacctagaagatgagatataagtaatgtagtttaggtggttttggtgtattatctatctccaaaatcaaaggaaatggaaggattcctctaagaatcatcagtaaaaatgtgagttttgctcatatttgcattttgcctaattctaaccctccataatttattgactgaaagctaaagaatattaagagaaaatgacaaaggtaattttccttccactgtgtcatttcctatcaactatgcgatttctttattttttaagttttgaaaaattttagaatagttttatgtttctataaaaattgctaagatagtacagatttcccatatatgctgtatgcagtatcccttcttgttaacattttatattgctatggcaccttggttacaatattgacacatatttattacctattttgagatggagttttgctctgtcacccaggctgtagtgcagaggtgtgatctcggctcactgcaacctccatctcctgggctcaagtgatcctcggtctcctgagtagctgggactacaggtgtgcatcatcacacctggctaattttttttttatttttggtagatacagggtttcaccatattgcccaagctggtcttgaactcctgagctcaagtgatcctcccacatcggcctcccaaagtgctgggattacaggtgtgagcctctgtgtccagccccatgttttatttatatttattaactttttctcttaatcccttttctgttccaggatcccatccaagataccacattgcatttagttgtcatgtctccttaagctcttcttggctgttagctttctcagactttttttgttttttgagacctcattcgttttgaggagtaaaggtcaggcatcttgtataatgtcctttagttggcatttgtcatatatttttctcatgattagaatacgctcgtatgtttttgggaagatgaatgcagaagaaaagtaccatttacatcccatcatgtcaaggacacatcttatcaacatgacttcactgttgatgttgaccttgacttcctgtctggggtagtgtttgccatgctactccactgtaaagtcattcttttttatcctccctttccatagtgctccctgtggaaggaagtccctatgtgcagtccacatttaaggaatggggagcaatgttccatctctgtgaggttaggaaatccacattatcagaaagtctgcaaaatcagatacctacagaaattattcggaattcttctgcatagagacttatctattcttcccaatttatttattccataatttgtttcaatatagacttggatttttaatatattgggttgtaatacaataccacatagcttattttattgtgcaaattatcccacctttggtagttaggagctcgttcacttggctcctctgtccttttggcatcattgtagattttttaactctttatttatttatttaacacttccttactttttggtactatataatgattcatgttcaacttgcttatgttctgccctagttctagaatcaaccatttctccaaggagtcctggttccttttattgaaaaattgtattagaaaccaaaatctgtgcactagatatgttcattgctactgtggtattcttgcttctaggccctcttaattgacatagaaggagaatatatgtctgcatactaacccatctatatgtatttacctatatctatagatatttctatatgtacttatctgtaccgttattaagcaaaacatgaattcatactgatatatctgactctaatccattaccacacagatcattctaaacttatccctttgcttatccataacctcccactccaactgtgagaaatatggctcccatattcaccatccatttatttaattgttcgattccagtatacatctatagcagcaacagaattattaactgtgtccccatgaacaagaactcaattaattttaaaactaccatttttaaattatttccaaactttttatttctaactttgaattttcttaagcctgggagaaattttgtaggaaaaagaggaataaatgccaagacaaatgaaatgtcacaaaattaaagaatatgcatatggctaaaaaaaacctctatattaagccaggtagaaattcagtaagcctgataaagaacatggaagaagatatttacatttaggatatttagattagtaagctataatagaaaaataaaaccaatacgtcacaatcacatgggaagtaggaattaagatacacacaaaaagcatcagtgttggcaggtgggtaaatgaatccacaccagagacacagattccagaaagcagagaaaagtaaaattcctaatgattaatcaaactgtcagaggccaagagatctactgaaaataagaaagggttgaagggttgagatatcagtatccagatatccaagccaaggaaaaatttgatggtattcaggcacagggtcttgtcagcacttcacctcagggattttacagggtcctttgaggaaatgtctaagcatgtatgaattaaggcttataagaaaataatttaagaggatttagctaaaattaagcattgaagaatgttttttacgatgcaacacaaagctgtctccctcaagaagccttctgagatagccttttagacacagcacaatagaatgttcatatgatagttttcatcaaatattatttgcatatgtttgtgagctagagtgaggtctagaggatcaaggactgtaacttagttccttttgatcatcagcacctagcactgtgcttggcaatgagtgataactcagtacttttgtatcgagtaaaagaaagaaagaaaaagagagaatcccagccacataaacactcagtttatgaacatagagttgaaaaaaaaaaaaaaaaactccttccagcactaaatcaatacccttccaattgaataggaagtagggccttgccatgttgagttctccaatgacttttcaaaaaacctttattgctgcaatcataggtaattcagtgactgtttaaaacctatgatgaaaataaattacctgagttcttttcattaatcttattattctgtagtcccatcataaatagctcactagcatcttttatctttatttttcagagtggtacagctaagaaattatatcattatgcatttgtgttgtgttctaatttctgcctgatgcatcaataatacatttaattgtgttattcttttctgcagacagttccatctttggaaattgctttagtgatacaaaggactggagggtagatattctgggtttgtcctctaattaaaatatgtcactggttagactcagaatacagacaattttttatcactgggagtctttaatcccaaactgttcatagaatgagcttatataaacactgagatttgacacattcttccagacttgatgaaaaaaaatatgatatcccaaagttcttgatttgaagaaaaagtgaactttgataactttggtgagattttcaatttcttggccaactacaatttatttctgagcagttaatttactttttgcataatgctacagaagaattttgagaacaaaggatatgtggaaagcgctctttttattttttgctttgaatgatactcataatattatgcagataatcactgaagttataaattttatgcatttaataatttttatacatttaataattttaacagataattttgaagtctattcattttcataaacttataggttgggaacattgggaaagtcgtttagttccttgggcttctgccaacttatgtgtaaaaatgggctaacattaattcaactacttttcttatttgaaaaaagacatacctgaatagaagcacttgaatttgataagggagaaatcacctagtgtgacatatttacttactttcatggagcacataaatctctgttcctttccttctcacaaccccattgcatcctcgaccccaagaaacccacacattaaagcttttctctcttaacaagagacttctaaaaatacttccaaggtagtaaggctgaaggaaaaacaacaacaaacaaccaccaacaaaaacacattacatatgtaatttaggaatcattagaaatatgaactcatttaggaaataagatttctaacaactgaatcaaatccatttaacaagtcattctgtaaaaccacaaaaagcccagaagtgcacactattcatttaatatctgaaaaaactctttgtaacaaaaggtttttacttaacccaaaacatttctttagccttggacaggaattaaggcttagtacagcttgatgcaaatgaaaggaactggcatttatcatgagtttcccatgaagctttacagatgcatagaggatgcaggaaaagtagagagtatgttagtgtgtgtctgagtgggtggccaagttgcttaacttggaatttaaggaatgtcctctttgaggaggtaataagtggagacctcaggttctatgggaagattactcaaagcataaagaacagcaggtgcaaagatctggaaatggaacagaaaatctccacatcactccccaatttaaagtaaaatgtggcttatactattttttttaaatgcatgattataggaacgacagtttgcatacaggtagaatatgccagatgtgacagagattggccagctagtgaccaatctcctttgttctccctcctgagaacatgtcaagacaatacatcacaggtacccttgcagcaggtatggtttcgtgaataaataaatgatgaccagtggactctggtggaagtttctggcccatgaaaacttccagggatgatccttcatgggttttttgcctttgccaacaactttgaaaggcatgtgtggaagactgcagagcccaagatgaaagagaactgggtctctgaaatgccacttgttttttgtttgtttgagacaagatctctctgttgcccaggctggagtgcaatggtgtgatcatagttcactgcagccttggtcttctgggttcaagtgatccttctgcctcagcctctcaagtagctggaactacaagtgtgtgctaccatgctgggcaaattttttttatttttattaaagaggtctggctatgttgcccaggctggtctcaaaatcctgggctcaagcaatcctcctgccttggcctcctaaagtgctgtgattacaggcataagccaccacacctggcctgaaatgacattggaaatagagctgtatgcttaccagaaacacttttgttctgacaaacatctacattttaaggtttgtttgttttatcagtgttggcctcaactaatgtgataagaatcattttctataggtttgggtgctgttctaaataacataatcataattaagctaccagcaatttaacaatgaaaaacccaggggaatatcttagatgcagagcaataacttattaaatgaaaagaataaagctgatgtatgttgggacagtcacagactcattggataaaatttcatgttttccaattccctggcacaggatcttagaagtggccattttacctccaaagatagattctctactgtatccaactaattgtgatgttaaacgtgagtatctgagagaaggtttgttttatagtggaaatccatggagttggccatattaacaaaaaggactgaattgtaaatatcagtaaataaagaatatctattgatacaagtcattttactaactcattcctcaagaatttccttgagcagatatacatatacttttttgttttgagacagagtctcactctgctgcccaagttggagtgcagtggcatgataatagcttactacagtcttgaactccgggactcaagtgatccactcacctcagcctccccagtagctaggactacagacatgtatcaccatgcttaattttttattttattttattttttggagacatagggcctctcttttttgcccaggctgctctcgaactcctggcctcaagtgatcctcctgccctggcatcccaaagtgctgggattacaggcatgagccatggcactcagcccacatatcattattggttatgcattattggctgttttgccaagattttgttttgttagttcacagtgttgagtgaatatatgtgtgactagttgattgaatggtcttaacttcttgaggcataacagaaaaacaattattttcctaactgctacctttaaaattctttgaagcgtatttcttccccaactctggataatctcttgtgcaaatcccaaactataaagccaattatattttaggaaagagtctcattttagtatctatgtcacaatttcctatattgcatgaagccatgaaatacagtctaataaacatttcattctctaatgcaaatgtctcccctgcagtttccattcaggcctattccagacttgtagagccacagtggagtagagaaaaccactctttactcttctctccttttgcttctttatcccacttgctctgctgcttcagattcttccaaaatctgggcaggagaggagcttatgagagaaacagcaggcaatagggtttttgttatgtggcacaccttatagctttctcgtctttggatttccctttaggtcaggaatccaaatgctggctctctcttgggatataaatggagtccccatggggccatctgtagtgcattcttctctgacatgtgttgtacatttccgggctgacctctagtaacagctcgtgcacctgttgtcaattcaatttaccccacagcctctaaacactggggcttctttgcctggtagatagccctcttagctgaagtgccattaggtgtgttgtgattatcttttaagacatccgctagaccaatgggaaatacatacatccaagctgcatcaagtgcaaggaacttcagctactgcattccctctctatcctgctccccatcacaagaagctctagacagacatccatcttcggaattctctagaaaaaaagcatgaccagtctatgcttacatgcatttgtaccacataaactcctacaaacatttttaaggctctcctcaaattgtgtctttacattccattctaatacactggattagcctttgagtttctgctgcttggaaagtttctggacaagcaacaagagtcctttctctccatctagcagacaacttggtatctttgagaagacctcttgaaaagcacttctttcacatgaacggagcacaactttccaatctacagagggcaggagaaaggccaagggtctgcctcagtagatctaagactccctaccataataagaaattccattccacaaagacatttggcttctctttaatagggtgaatgggagttcaaatatcacttaggcaacctcaagctctagggggattgtctggtggctcaagcactattatctggggctagagcccaaatataaagataatagagaaggtttcattttccatcctattacagttttaaagcaaatatttattatgagctctgtatgaagaattttataatcatcatctcctttaatcctcataacaattttatgtggtagagaggatgagtccccaatttcaggtttaatcacatggcaactcagcaaattggtccaggtcatcaaacaccttgtcagtcagcacactaggaatctgacccagagctgagtaatgtcattcttttaactgtctcaatgttagaagatttatgagaagacaaatattataaaatcacatttaatcagcatgagtgttagtgttggctatataaatccaagataattaactcaaaactttttagatgttataaggattgacttagaaaatttaaaatttataattttctaaataccaatgacagccaaatggaaaatctaatgggaaaaaaaaagatctaatgcaagactgcaccaccaataacattaataacaaaatttacattatttagaaatagccttaactagaaatctgaaagtttatataaaaatccctattaaggtgctgagtgcggtggcttatgcctgtaatcctagcactttgggaggctgaggtgggcggaccatgaggtcaggagttcgagaccagcttggccaacatagtgaaaccctgtctgtactaaaaatacaaaaattagcctggcatggtggtgcatgcctgtagtcccagttactcaggagtctgaggcaagagaatcgcttgaacctgggaggtggaggttgcggtgagccaagatcgcgccactacacatactccagcttgggcaacagagtcagactgtgtaaaaaaaaaaaaaaaaaattagtaaaatatacaataattatccaagagatatgttatagatttatttgaaaagtctgaatatgtcaaaattactaagtctgttaaaattaatttataattaatcacaattcaaaattaaaatatcccagtggaatatagttgtgaatctgacataatatacttcctggaagtacaggtgagcaggtgagagaaaaaaagataaccaaagaaatacattaacaaaagacagtacagcaagttgtaaatattcaatctatatatttttaaaagcatcatgtgtttgctggtcatcagtttattgactctgaactccatatccatccttctttgctgctctgtgaaaatggagctggtacctttcactattcgttctttgttggctggctggatgttaggatgttgggtttggtcagtaaagggtgctagagaggaactgcaggaggaaagggttttacttctctgttctggtattcttgcttgtttgacaaaactccacagtgcacctgatttttctagcactattcctgcagtgcagaacagctagcagattcctggaccaccccactttgacagttttgagtcaagtgcctctgagataccttctcatgagctactttccctaaaatcactgctctgctctctccaatctttgtgagaattggaggagggcaggagtctggatcaaacaaggatatggaaacaaccttattatcattaatgatccgatgatgataaaagataaagaggtttaggattttgtggtatgatgaccacagtgattgttaaacacttacctttttttttttctgttacagattgggttcctacacaattcagaactcaacacaccctttgcacttccttcctgtacagacatgttattatccacgagttccagttttgttacccctggaggctgcttaaacaagtagacctaatgcattctctatttcttccacaagagaaaatgtgagctacacagagtaagacagagtcagagaaaagagaaagaattattcaatcaaaatatcatttcagtactgctaagtccttgattagaatttctcaagtggggtctgttgattgtcagcatcagaagtaactggaagtaccaggtaaataactctagctcacctcctaagattctcattccagaagtttgtgggtggggccctgcaatctgcataatttgagccttcagctgattttgatgcagatggtccaagagctactctttgagaaccaattctgagataaatgaatgttttagaaatattaaaacagatttcaagacatcactaaattgaacaagcaagaaaagatgtcttttatatcaacacatcatccaaaagctttggattccattccaaatggcagtttatgcctgtatcaggagctaaggtgattgagagtgagactacaggtaattagagaaagaaagaagagaaaacctgagtgctagagctagggctaatgtatattgctgagagtcaacaaagaaaaaaaatagaacaagtcagtggcttgtaataagactgaatcaacagcttcctgtccttattgcaggatctagtgggacagctcagcttggggacacagaatcagaaagtcaggcctctcaagtcctaacagcaataaagagtttagcccaattctaatgacagggtagatatctggtaatctccacactggtgctgtcatcttgatcttggtttggctttcatcagctcttgactgatccaacgtgactagtctccctgcctccaagctcaatccacttcaatcgtttctctcccataatatttcagtagcctcccattgcctacctacagcaggggtccccaaccttggggctgtggactggtaccagtccatggcctgttaggaaccggctgcacagccagaggtgagcgactggtgagcaggcattactgcctgagctccacctcctgtcagatctgggtggcattagattctcacaggagtgtgaaccctgttgtgagctgcacatgcgagggatctaggctgcattctccttataagaatctaatgcctgatgatctgagatggaacagtttcatccccaaaccatccccgccctgctctgtctgtgcaaaaattgtctttcacgaaactggtccctagtgccaaaaaagttggggactgctggcttacaggataaagtccagtttctctctaaggggcatgtggagggggtcacctctcctctatctaaagtagattagttggatttcaatccattttttatactgacaactgtgtgatgttaggcaaatgatctaacttccctggctgaagttttctcatctgtaaaacatagacatgagactcaatgggacactattcacatgaactatgatgtaaagagcatcctctggaggagggcaatgaagcagcctgaaaatacacacttcacatgattgccaggaagattgatatagtgcacacaaagtctatatgatagtgcttggcacacactcagtcttcagtaagggttgacttggatcattattgcccctctgttatttcttacatacccttgctttccattcttaccaagtaactcatgatttttcaaatgatgctgtttgatacctcacactttagctccactgttttttcagtgcaaatgccctcccctcttcacatgatgaactcctactcatcccttaagtcctagctcagatgtctaatctctgtggcactccctgattccaccccaaacagtttttaaacctgtattttcattaaagctatataaagtccacacctccattattacaataaatcctctccacagtaataagcctttcatgttgacagtcttctacaggaagagtatgtctcaaactgtgccattagttataccaccttcaaaacggatgccatatccttctaaaattttactgtaatctacttaatccttttctgtaaatcaattcataattctacttatataaatttattttaaatgaaactttatataattcataaaaaattaatgcatagttattctaaagtaaataataattacaatacaataaaaacgtcatatccatctactaactcatccattagcagcactcttatgggaaaatctgtactgatatataaaagctctttcagtgcaaagatatctgtctttatatccccagtacctattataatgttggtacagagcaacatcttgacaatttgaattgccatactccttcagaaagccctggcttcaaatcttgactttaacaaggagaaattaatttacagatatttataaatttaaaatctactattagaatgagattttgcagaaaataaaattcacccgaatattgtttatctatggaaacaagattctcaaatctgcaactgagcatatagaaaactaatacgaaagaatatcctttgaattaactgagaaaaaattttcgttacccaccaagaaacttttttcttttggttatttagaactatgacattcttcttggccaatagttacatcagagttaaatatgtgcctcacaacagctgaaagcctgtggtgtttgtacactctttctgctagtgttgacttcacttttgagttttctcttgtccatttggggggttatgttttactattaaaacttttaaaaagtcatttatctaatatttttattgagccagagaaataactaattcattaattaaataagcaacccaataaatcaatggatgaacagattgatggataaatacacaaggtcatgagcagtccttagatatgctaatgcaattgaccagctcagctgggggaaaatgagtaaacagacaaaccttttgtgacatgtaaattaaaaagcaccttgatggacatatttttttcacttcttagtctcttgttacaacaacttgaaggcacagcctgttgacaccaaaaccagttcagtttagcaacttgggacatagactgtaagaaataacaactgtgcagatgagaaacaatagaggtgggtgttggatctgctaagaaagtgaaccacatatctttctctccgtgaagcacaagacatatgaaaagaaaaaacaaacaaacaaaaaaacccactaactctgatgcagaagcaaacagatactacaattgtgctggcaaatggtaaactcacagccaggaaaggggcaactgattttctttgctatttatgtactaaaatcactggtcccattgggaactagcttacttaaaaggctacataggctgggtgcagtggcttatgcatgtaatcccaacactttgggaggctgaggtgggcagatcacgaggtcagaagttcgagacaagcctgaccaacatggtgaaaccccatctctactaaaaatacaaaaattagtcaggcgtggtggcatgcgcctgtaatcccagctactcaggaggctgaggcagaagaatcatttgaacccaggagacggaggttgcagtgagccaacatcatgtcactgcactccagtctgggtgacagagtaagactccatctcaaaaaaaaaaaaaaaacaactacataatattataattttatttattaaaatcgcttccacgttttttatttcaaagcttgaacaatactacatatgcattgattacaattcaaacttaatggaattctgtggtagcataaatgctgatttgtttttaaatgatagcataaatgctgatttgttttaagtataaaacaaatcactcagaaaaaaactggaataaaatactttcttcttctccaacagaaatctcataattatatctatttggaaaatatatgaaacataaatttacatgaagtagaaaataatttggatgtcatgtaagaagtcttatatattttagtatatagaaggattctataagcatatgaacactatgatgaaaaaatttctttttcagaaagcttatttaaaaccaacaattacacagtcactttgaaatagcacattataattttgcatagacactttgatttcagagttaataaatgtaaccaatacttcaaaaagctgacttattttccaagtaatatatccaactgtttatgcacattttattaccatctttctctcacacacttacatataaaagagaatgaatattcacaaatcagaatttatcctaaaaattttagaaaatgaagcatccaggaacacagactaaaaatctgcaagtagaatttacaacttcctaaaattaatttgagataatcaaaaattcaagttcacatacaaagtcagtgttattgaaatccttttatgaagcccaacatgtaggaagcaagcaaaaaggctacacaactgcaatagcaaataaaatcaactaaagttatttaagcattaaattcctacaatactagcgtttcgaaaaagcgttgtctttttattcatctcgaaaatgcatgtttttttgaagccatcatggaaaccaagagacaatttcacttaacttttaacgtttatcaccttaaaactgggtttttataggtgagagaactgatttgggagtcaaatggcctgggtcttagtttctgaaatttactactcattagcttatttgacctttagcaacttcatcataaaaaacttctctgagtcttaattgctttttctacaaaacattaacaagtatctttgccaccagaaggattaaattagacaaagtatatagagcagatatggattccaatcacgattttttagttatgaaaaagtacatgtaagtaaaagtcattgcgttattagagattgataagttcattacagtagaaaacttgtttaaatgtatgcaaaataaacctaggaaatgaagggtacattagtgttttctgttttttaatttcaaactcaacagtaaaagtactgtcataaattctatgtaaaacacatgtgactcttcatatgagctgattatttagacttaaaatatcacttgggagcttgtcaaagtaaaacctgttgaatttaggaaagccagattaaattttcgactatgggaagttaaaaattatactgtgagttgaagaggaggatgacatcaatcacatcttcttttgacccattcttaacgtgcactatgatgtacatcacagcttcatcttcttaactcctgtgttcaaagcattgttaatacagatcagtgtcaaaataaaaggtgcttttaagacacttttttgggaacagtagcataaatttaggcaagacctctaatctctaacttctgaatttcttataaatcaatgtatttttgcattatttacattcatgaggcacctcctcatgttctcttgcctccccaagatgttagagttctatgcctaatcatgaattcttgcctgagtcagtgacaatatttaagtctaaaaaaaaatttagtttatcaactgcctttctctctctctctctctctctctctcacacacacacacacacacacacacatgccatgtcctaacttgagcaaatcacagttcaaggaatccacaaataacttgtcatcactttgcacatgtagaaaagaagtgacagaaatcacatttggaacgggacacagtactaccctcttacctttcatctgtctcgttggctttatttgaatgaaaacagtcaccatcatatccaccatcttctcattcatgtttaagatgtcgcaaaatttcttatcaagctgatacattacattttcccaaatttcacatttagaaaaaattttaagaaatagcgagatgaacaaaaaggttttgtttctccaaaggtctttcgcagtcttcccagttctgaatggcaatggtcttcaactctgcagcaattatgggctgtactcctcaaattcacattttgggaatgcagaagccttgtgtgtgtgtgtgtgtgtgtgtgtgtgcgttggaaggggcagtttatatgtaataccatgcagatccatagtctatgaacatcaccaaggttaaccaaccttaaatgcaactatcagccccttgccagaatctgcagcaacctccttttttatatatctggttcaaatttccccttgctgacaatttaaaaataattctctctctctctatctctccatagctctctgtcactctgtctttctggatgaatacatacatagacaaatgagggagaattttctctctctctctctcatgcacacgcacacacacacacacacacacaagcacacacacacaatcacccaatgcaggcagcttgctaaaggatataactctaattatggtttcgacccaattccccctggagtccccaaattaaggttcaaaattatgagagcagtataaaggagaaatttactttataaaaattgtaatatcttagtagcccaaatccctttactatcaaaaagaagctgaaaacggcacattcatccctatgtcaaggtctgatacatgctcaaaatgggaaaaagaaaaagaaaatgagttattttcttctaattaaaagcttagttcagaatgagaaaattgaggtggaaggagtctgctttttatgaaagaagtaataaccaggcacaagatagtttagatcttgcctaaatgaattgaaactgcacagttaacataaaagagagatgtcaaacaatctttgccattgccaatcattttgccctaagaatatacaaatccccagatatcaggtttttagtgggcacagattatattttcaaaatttattttttttctcagatcttttgatttagccacacttgcctcttaaatgttccctgaatacacgacactccttccttctgtgaaattttgcctaagttatctttatccgaaatgttgttacttcttgtctccaggctcctccatttcaggaataaattatgaaatcagaaatgttaattttccgtaataagggaatcttattaaaaagacttgagagctggaataatttagaccaaaagttacaggtcctattccgttttgccacagagtgcgggctcactataacccttagcatgctctaaggggttattagggtctccaggtaatattgcataattgctaatgcattataatttttggaagacatttatacccatagtttgttgaatctatatttaccagttcttctggataaacaccttctgttttctattaaaaatgattttacctttacatctaacagttgtctcagtaggcaggcatgaaattagtatgatcttaggaactgagatttatttaatgtgacaaaattccagtccactgtcttcatctgggattaacttcacattttaaaagtgtatgctgcttctatacttcatttttataaagaatattacatttgatggggaataattaaggcaaaatgaaaactgagctataattttacacctatcatcttgctaaaaactagtcttgtcttgtattttcttgccttagccactctcttttgccaaattctcctaaatacacctctctcattatataaagcagtcacaacaattaactattggggaggtaaaggtggaaagaggtattcaaagcaagcaagtaccttacataacctgtaggtccttgaggtacatatgcaaacaaaactgtaatcatagacctcaatcatcctaataagtcatgaatcatataatagcaatttcaactgtaataagtaacataaccagttatattttgcactaaaaatatcaagtatgaagaaggcatctaactatttatttgtcaaactagacacttagatggactgttcatttcaaagcatgttttgggatctttttttttcttttcaccaaaggtagtcagtggctgaaatgtctatatggaagaacagaaagcccaccctgctactttttaaatcttttatagcagaaaagtgactgatagaaggatttaccagaatggtcatagagcaagtgagcagggacatagtttagcattaattccctagaatgctaaggccagatgaaatcagatggagtgaaccgtgttgatcaagctatgcttcatatttcatgagagcagtgtcttagtgttggtgtttgctaacagagaagctatatcaaaaacagctttcagcttttgatttctgaaaagtagtgaatatccacatagaatagtgactgacatttaattacatagatcatgtctaaaccacaatccagtcctaagcttctcaaatcttctaggatgtctgttaaaaatgttaattcccatgctccaattccaagcactctcatttactggctctatagggctcaaagatctacattttaaacatctcctgagcaatttaatccacccatcatcatatattgcacgtctgtacccagcctggtcaacaatgtagtcatgatagagtggtagaaatgggctaggtgcagtggctcatgcctgtaatctcagcactttggtaggccaaggcgggtggatcacctgaggtcaggagttcgagaccagcctggccaacatggtgaaaccccgtctctattaaaaatacaaaaattagctgggcatggtggcgcgtgcctgtaatcccagctactgggggagctgagggaggaggatcgtttgaacctgggaagcagaggttgcagtgaacggagatcatgccactgcactccagcctgggcaatagaatgactccaactcaaaaaaaaaaaaagaaagaaagaaagaaagaaagaaagaaaggaaggaaggaagaaagcaagcaagcaagcaaagcaaagcaagaaaagaaagaaaggaagggaaaaataaataaatgaatctctgtgtggctgatctaagttaggggcctttctttagggaggctaattcacctgttatccagtttgaggaaacatccaggctgaacctttctagcttctcaagttagaatacaatgatttggggtttcacacgggatactatcagatgatattttagatacaaattgatgtccttttaaaaagtcatgaacaaaatgtaactgatattatgttttaattagcttcagtcagcctacaaatatatgcattttgacgatgttaccaaatttgctgcccattttacttaaaatcaatagaacagtttgttgtgaattcaacaatccttacagaaaatctgtcctctttgtggtaaggtagccaataaaagtttattaatattcactatagtaacaagtaataaaaaggcatctaaaatttttactttaaaagtaattgctctagacatttaagtaatctgattgatttaactctcgagtgatgatggtatcatatagcctccatctaatgagcattgagctgctttcaaagcagtgtcatatatatgaattcatttgatatttacaaggtccacagagcatcttaaagtttagagagacatgttcttgaactggttctgtgaactgtagtttcatagatttttccccccattggattttcttatcacataaaatagcagtactacaggaaaaaaaaaaaaagatcaagccaaactcagaacttatcagctctcatacacaatcattttctcctacaccgataggttgtgaggctggcaaatttctatgaaagaactttgtgacagtcccattagacaatacccttatgtatcccaacaactttaaactcaagcaatattgaactattctagttttctgcaggtgccatgctgtttcatgattacatgactttgtccaactgtcccctctgcctgggacttctggcttccctctcttttctgcctggacaaatcctattttccctctaaaactctgtttaaacatcatctccatggaaactttcttctctgttctccatctgtattatttgtttacaaacccaacttcccctgactttcagcactcaaaaggcaaatcatgcatcttattcatcttagtatcttcatggtgtctcctaaggctaaaaaatcaatgaccaatctgaaacacaatattaaaagtgactacttttctcactaaatccatttgaatcacattaataagaataaaataactaggccagatgtggtggctcatgcctgtaatcccagcactttgggagactgaggcaggtggatcatctgagctcaggagttcaaggccagcctggccaaaatggataaaccccatctctactaaaaatacaaaaattagcagggtgtggtggcaggcacctgtaatcccagctactccggaggctgaggcaggagaatcaattgaacctgggaggcagaggttgcagtgagctgagatcgcaccactgcactccagcctggtgaaagagcaagactccatctcaaaaataagaatacaacaacttaatagaaataatttatgactattatgtggacatgtgcttaaagcagttatcctacagccagttgattttttttaatttttcatttacattttcttttcagtaggaggatatcagagcagttcagaatgtagatgttgaagccagactgtgtgcaaagcctgactcttcctcttcatagccacctgacattggagaaggcattcagttatctgggcctcactctattttgtgtgaaatgactagaataacagtacttgtctcactggatttttgcagggattatgtgagtaaatgcatgcagagttcttaaaacaatacatggcacctagtggattctcaatactggcaatttaatagttagtacatctactaaaattgttaattacctatgatcaaaagtatacatacaaaacaaccctggatatatttattcctgtcacatccattcatgttccaacatgttcttttgaataaattcagatggttttcattcatttctttacccccatacttttactaaaggagctacatgggtaaaactatgtaattaagtatctaagttatcattgttccattaaatataatgcaaactgcatgtacaattgtaaatgttctaatagtcacattaagaataatataaacttacaggtgacacaaattttaatattgctttttttttcttttttgagacagagtctctctctgtagcccaggctggagtgcagtggcatgatcacggttcactgcagcctcaaactcctgggccaaagcaatccttctgtctcagcctcccaagtagatgggactacaggtgtgcaccaccacatccgtctttttttgtgtgtgtgcagatggagtctcactatgttgcctaggttggtgtcaaattcccagcctcaagtgatcctcctgtctcggcctcccaaagtgctatcattacaggtgtgagccaccacacccggcaataatactttttctttaaagaaattttaaaattattttacttttaatattattaaatattattttaaacatgcaatcaatataaaaactattgagatccattgtactagccacattttaggcactcactggctgcacatggccagtggtctgggcactggcaatggctttatttttattttaattttttttttttgagacagagtctcactctgtttcccaggctggagtgtagtggctcgatcttggctcactgcaacctccacctcccgggttcaagcaattctcctgcttctacctcccaagtagctgggactacagggacatgccgacacgaccagctaatttttagtagagacagggtttgaccgtgttgcccaggctggtctcgaactcctgagctcagacaatctgcccgcttaggtctcccaaagtgctagaattacaggcatgagccactgcaccaggccaggcaatggctttttaattcaaagatgctatttcaactcaataagatgcagctttttaaatttgtcactaggtggtgttggagacaaatacagtactgctccttgactagaggaaaagttcttaaaatgatgcagtcaaatcttacagtacagtgtgcctttggctatgctgattacaaattctacaaagatagttatgatgaactaacaggataaaattatcatcttataataagaaacaagcaacattaagaagcaaatacatcctaattctcgtctaacagctattctgaagtttgctgggcccagtttatgtgcaagaccatgaagttttaaaatttcatgaagttttaaaatttctgcaattcctgtaaagtgtttaatttcaccatataagttgcatctgatggaatctctttttatccccagaaggcttagggtgtttaaatcacttgtttagaactacagtttatttagccaaatttcttttccagttacactcttgaacaatacttcacacagcatccaaacaccatagcatctgcccttgaggtttgaataggtgatatttattttgcttgcaaaaactaactaggaacaataggatattttcacttaaggatgcaactctcaaaggtacatgtatttactttctcatcaattacaacagaaatggttttcaagggaatcattatttaaaactaatttctaactccattcctttaaccaattcaaaaatgcctctatcttcagttacttgactgtgttctttgcttctcagtctgaaaacacgtagacaaacaactcagggttccaagctcaccggaaatataattatgcttattatgttacaaagcttctgcacctttaatcagaaatgtcccctcttccaccaagtatgaggattgcacagtggcaggcactgctagctgcttacccaatcattcttcccatgttctttgtaaatataactcagattttgctcagattagctacgtatctaattaaatattcatcttcccactgttggttgaagctaggagtaagtcagacatactctgcttcttaagatataataatttgccaagaaatactgagggaagcatttgctgcttttgcaaggaacagataggtctggtaccattcttctctacttcttcctgccttgaacatgctgtctgctgccctgaggcaattagcaaggggatgaaaactatgaacagcaaaagagagagatctgggcctctaatgcattgttgtgagctgatcaactctaggataccaccttccttcaaacttggtatataaaaacacattaactcactattttatgctgctgttagttgagcgctgttacttatagctaaatttattcctaacatggacaccttcttgcttctgctccctaaccctcactttccttctcaccattcaataggagtctgtatgccctcccctcggagctgatttcatagggtttttcccctcataggtcactattcatggagttgagctagcaaagctcatcccagctaataaatatatttaatattattgttatatcataattctgactcataagtaaattcaaaggtgagatttctatgaaaactgggaaggaatagaaatagatagtgatgctaaccagcatgtaaggggccctttacattttacagaggccttttgcaaacactctttcatttgaccccacagcagctttgcacaataggtatgattaatagtcagtcctcttttacaggtatgaaaattgaaccttagaaagattaagttactcctcactgtcatacatccattataatataaacctcctgctggagacttggtatgacaataccataatttataccatttctacttaattcctttgcttgttgggatgataacaaagattaacatttatcaaagagataccagtgctgtaggcatttgctggaacaagagtgttatatgtgttattgcatttaatcctcacaatcctatagcctgataccattaatatacccattatagatgaggaaagtgagccattatccaaaaacaatccaccctcctcagccactcctcaggctgttcctgacttaatgcctacatagcatatccctatctttagctcctaagatgttggacttttgtttttgagtgaaaaccaagcttctaaactagactcacctgatcttctggcctgtgtttgtacaattatttatttccattgctgttagactgtaaatatcccctgtctttaagaacggcaacaatctggccaggagcagtggctcatgcctgtaatcctagcagtttgggaggctgaggcgggtggatcacttgaggtcaggagttcgagaccagcctggccaacatggtgaaaccctgtctctatgaaaaatacaaaaattagctgggtgtggtggcgcctgcctgtaatcccagctactcggaaagcagcaagccgagatcgcaccattgcactcccacttggggcacaagagcaaaactccatctccaaaaaaaaaaaaaaaaaaaaaaggcagcaatctgtctcatatcatgtaaaattgcagcattaaactatttgattttattttcctattgaaatgatgttaatgaattttggctctgaaagcctgtacttcaaaaaaaactcattggattcctgacttttaaattagcttacagttttctttcaactccaagaagaaggtttaatttaaaatgtacttaataagaaagtatgcacttcaaagataagcaaatacagttttcatgtggtttaaaacaaggactttattgatcaatacaaaggttggggtgggggaagaaaagtcaatacataaaacaagatacttgtacttattctactgatactattgacatcgtattactcttgaacaaaaaaaatcaggcagatttagacagtgggtgtttttttttacttggatataaatatgtaaatgattcctttttgttctgataacacaatggaataatgtgggttctagttttatccaaattctgccatttactggttgctagttactagaccattaacaagttgatgatactctctaagcctcagtttcctcatctctaaaataaagctaatatgttgacccctcatttttatttggaactttaagtaaactaatagatttaaattgtttggccaggcatggtggctcatgcctgtaacccagcactttgggaggctgaggtgggcagatcacctgaggtcaggagtttgaaaccagcccggccaacatgatgaaaccccatctctgctaaaaatacaaaataaaaattaaaaaaataaaaataaaaagttagctgggcatggtggtgggcgcatgtagtcccagctactagggaggctgaggcatgagaattgcttgaactcgggaggcagaggttgtagcgagctgagattgttccactgcactccagcctgggcgacagagaaagaccctatctcaaaaataaaataaaataataataataaatcgtttgccacatgcctgtatatagtatgcattcagcaagtataattcatactcttctctccttaaatctcccaaactaacttgattattttaaccatgcttctcaggtttgttagcttttgaaataaaggtatttctagaaacctgatactaggaaacagtgtattaaagaaataataaataaaagtcatttttaggatatagctatcacttttgtgacctaaataaatagtataggcttcatattataatgacattttgtatgctctttaaagcaattttatttattttcattttctttttaagccctggtgaatgtcctcattcttgggttttactttctagaaatgcttgaaaatagataaataacaatattgcattatgtagatgacaaaagacacgtacatgaaaaagtgtatatttccaaagaaaattggaaagatctccatctttctatataaaactttgaaatgacattgattaaattatagagaaaggctttgtttggtaattttcttaatccctagaaattccaatcatcttcaactgaagatggcaataacgctccttgtaagtaggacaacgggagctcatgacatccacagttgttggagaatgagatttctgactttcagaaaatcatgtgtctgaatttactgcaaataatttaaactgtggctttcaaagctgccccttagagtcccgtgataacttgtgcataagtctctcaagcctgctttacattctattttctttttatatatacctttctttatcactacaaagtgtccctattgagattcagagacaagacttaatttgattttgtgttaataataccatccagcataatggctgacacaggctgatagacagtcgatacaattttaatagagtaaaagagaaagaaaaaaaggaaagatggaaggaagtaaggagtagggaaagagggaggaagagaaggaaggagggaaggaaaaagaatgaaggaaggaaggaaggaaagaaggaaggaaggagggagggagggaggaaaagagtgaggaaaaaaggaaggaaaggaaagaagaaaggaagcaagggagggagggagggagggaggaaggaaggaacgaacgaaggaacgaacgaaggaaggaaggaaggaaggaagtctcctttgtatcagaattgaaagctcatatttatttcagtctgcctttcttaaagtgaccacattttgaactgagttcattacccaagcagtcattaaagcaatcctattgaaatactattactcctttaatttgtaatgacttcacctaacatcatcttttgtctgaaaggtttttatttgcagatggcattcagacaaaaggttagtcattttttaatcaaatttgaagcacagtaaatgacaattgctccttggtaaaagatgacaaaaaaaaaatctaagaaacttatgttttattttgtacttctccacagtgtggcagcagagacttaagaagtggaaaaagtcattcagagtctggttcagggagactcaggccacagagatattctcaacacatatacatgagaatcaaatggcaataggttcatctgtgctcacaagtcctgaacagaagaaaatattgcttaacaagcatcttatgtttgctgtaagatatgcattggcttagctgaagttcccgcagcatttaataggtaaaatctattggaaatgttaatatttcttttggactgaataaaggtctacataattggctgatttatatgatattaatctactgaaagaatgtccagttaattgcagcaaacctttattaaacaatgaacacaatctcgctttatggcagttctgttaaataaaaatagcagcaatcccatatgggtgtcacaaggattagatgagataacacactaggaagtgcatgtggcttgtgtggagtaagcggaagataaatgctgttacattgttaccattttctccactgctaccattgccattccacctccactcacctgataccactatgttccaggcagagaaacactagtcatttgtggagaaacaaaaatgactaacaggacagccctgctgtggaagagttccttctccagtaacagagatgaaggtgtaattaaataaccatgtcattgtatgatatgagaacaaatccatctacctccacatgtggcttgggatttgcctttacctttactattccagaagactctcgttcaggcaaataacttaacagctcattacgttaaagaaacttcctgaaaaatccatcagctcttcatgagaaagcatcaacagacaacaaactcatctttatcaacagcttgtgttggtgatatgtgagaagctggcattggacagataagtaccagaaggtagcataatacactatgcatcctttatcactggcatgaagaaatcagaaaaacatgggtttgaatcctagatctgcctcttactatctgcaggattgtgttcaatgtattaaataatcatcagcatatttttgtattcaccaatagtattttccccagtggtttgctgtgagagtggaatagtgtaacataggcagaaccttcagccttcacgtggcatgtgctaaatgctcaatacattttttctcatcttcctcttaatcattctctattaactgctctttcaacgttgctactttattgtttttagttagctgtcatttagataaccacaagaggaatgaaaagaatccaaatccttggatgaacaacggtacaaaacatatttagtccactctgttgggtctatggatctgtacgacctgaaggtaggagaaggatttaggagagcttggtttactaataagcctaaaatagcacctcctacacaagaaaacaggttaaaattatgatcaaacactagtcaggtttcctttcacaaaataggtgtaggtcctttcaacaaaagagctttgtaaattacagcagatgacaaagaccttgagaaaagtgaaggtattagccttgtgttgtcactctttctaacgtgaggctgtcagaccttctaaaaaaccagaaaaatgttaactgtaagatggtccctgaccctttggagacaatgcggtttccctgatgtaaccttacaaatgaaccatttgggtaatttgcatgagctgatattgtttctaagtggtatttatgctttcaaaaatgacagtaacatgatgtctttagtaacatttcccaaggagtgaacatgttcagttcagcagagaaaagcatagtgtcactaactccaggcaatcagattgctacaagcctaatgtttttcaacacagcacacagaggaaaaggacagatattttagaaaagacatcattgtattattgatatccacacaataaaatataactgcttcaagtaaagtgtatgtttccacagagaactcagagccaacaaaaacagccctaatgggaaaaatagtaactaaataattatggctcttctttcctcaaaagaattaaaattgcatttatggataagcaaacccaatcaacacagggtcgttggagggttacagaagaaacaagataaaaataaaaacggaaaaattcaaagtaaaaggagggatagaaataggaagcaactgttaaattaaaacaaaaaaaagtgaaagaaagactctctctcaattagatattctcagatatttgccctcacctctcacaaagagagtagtggaaaatataggctctccactccttcccaaggaaagcatcactatctaagcctgatgtattcatcttctgggggagatgtgtgcctgcaagaagacatttcattatttaccaattaattaattaactcattcatactttcttacttctatcctaaacatgacctatgaagtccatttgatttagccactacctatttcccagtattacctaacataatatgttcttacattctagctatcctaaatttctttcagtggcttcaccatctccctccttttctctagaaatgatttcttccttctttaccaagctggtttccacttatcctttaggttggtgcttaaccatcgcttccctagagatttccatatgcccctcaactaggctggagctcagtgatgggggctcctgatctggaaaaactctccacttctgtactgccatactcattgcatttataagtttctttctcaatgggtgctatagtttgaatgtgcaaagatcatgtgttggaaacttaattcccagtgcatttgtgttaagaagtaggaactttaggctgagtgaggtggctcatgcctgtaatcccagcactttgggaggcagagacgggtggatcacgaggtcaggaaatcgagaccatcctggttaacacggcgaaaccccgtctctactaaaaatacaaaaaaattagctatgcgtcgttgcaggcgcctgtagtcccagctactcaggaggctgaggcaggagaatggcgtgaatcctggaggcggagcttgcagtgagccgagattgtgtcactgcactccagcctgtgacagagcgagactccgtctaaaaaaaagaaaagaagtaggaacttgagtaattagatcataaaggcttcagtctcataaatagattaatgtcatcatcacaggactggttcattatcccaaaagtgggttccttagaaaaggaggagtttggtccttcttgccttctctctctcttttgccatctgctcttccaccatgggatgacactacaagaaggcccttgcttgatgttcatccttcagccttggacttccagacttccagaagcatgagacaaataaatttctgttccttatacattacccagtctgtggtattctattatagtagcacaaaattggctaagagaatgaggtctgtctcttgtgttcaccagcgtgttatcatcttcttgcagaccagctgcaaagagtagtagctcaattgattattgttcaatgacagaataaacaaatcaagaaactggttgatgaatgaaaaacatctagcaaggaaacttatgttgagctctaaccttgagcaaagtgctatgagaagcaagggtgtaggtaagggaggaatcatagtgtcttcctaaatatcttcagaaaaagttgtcatttccccctttgttgtcccacgaataatacttgtatctcatgtataatatacataagttctcttcatatagcccaaagttgagtcaatgtacaaagtaatccagctctattgagtcatctaaaatctaggtcagaaactgtcacatgtgcatatcaaagggcagaataagtcctaccacaacaatcacccttttcctttcacccactgaaaactaatgaaaggacctggggagaagtacaggagagacaagattggtggatgttctttttctctctcaaactccccaaactaaattggttgttgacatctgtcagagtcactaatcaatatttagggtacttataaaaaggaaaggcttgcatcagtttcttctcctgtagacagctgagctgaagaatactcaggtctccctcagcacgagtcagaaaatctgtgcagaaccctgtggagttgtgtctgggaagagttttcgaacatgaagttatgcctgggaagaggaagtttaggaacatgaagttgtatctgagaagattttagcaacacatgaagtttaggaacatggagttgtgtctgaaacggtttaggaatgtgaagttgtgcctaggaaaaggaagtttaggaacacgaaattctatctgggaagagtttagaaacatgaagctgtgtctgggaagagtttggaaacatacacaatattagagactggttcctgattgcactctggagaataccaaagactggtggaggattggtacagcagcccatgtgtgcagagaatgtgatgtagcatgcctgggaaaaatgggtacagctcatcccaagtccatgaaacactcaggggatgtcagagaagatcctcatagctttttgtgaagaacaatggaaattctaaggcttcatgaacagctgaaaagtctaacatagataaaggggttgtacatcctccatgaaggcagggccacagtgaagctgaatatacactcccaggaaaataatgagtacaacatactcagaaacaaccacgtcagagtgggatccaggacccccttcctgtaaataaccataaacacaggtatgaagtatttttctccctccttactctgcctcacataccagaggagcccagtcataaatgacacaggaaagaaagcagagagttttgaacctgaaatgtgattgggaatttcaacgtcctaactttaataactaaaattaatcagaaagttatagaagattcccaatatgtgaatggaggcaaagaagcaggggaggtacatagtaaaattggagacagtttgtaaaagaaataaaaccgtcttgtgtttatgctccaatgaatcgaggtatttcaataaactggtatgtttctgttaatcattgattttttttatcctgcctaatacgagtcattacatgcctacactccttcagggttaagattatgccttacttatttctgtaacagcaaccctgttgctgacatattgactgacattcatcaagtacttgttgaagaactgctgtgcacataaattcaaatctcccttaacaaaaggttaaagaaacaatcatgggagtacaatgccaccactagtgcacctgtgcttggtaattaccctctctgcatgcacagctttccctgatacattgtagaagacctaaactaggaaacttctaataacctctaccatttactgtggggtttgctatgtggatgttatcctatttattccacacaaaagcctacggtggtattattcttcccatctcacacacaggacaacgaaagctttcagaagacaggggcttgcttcaaggtcatactgctagtaagaattgaacatgagatttcccatcccaagactttgagattccaaatcctgctcctattccaccctcccacatttttcatagtgcctcatccctgaatttggaataagatcaagggtagtacacacaccccctactccatcaaacattcactggctatccatgggatcaatatattggcctggcaagtccatagacagacacagtaagcacgaatgcctcaaatccggcatcaccctggggagttagttgcaggaaattgctttcttccctttcttcttctttttttcttcagcagtcagttctaagacacctagtagaaaccatttgcattttctctacagtggaggagaccctaaccctctaatcatcaaggaaacacatataggctgaacagcaacctgctggtgggagatgcagcgggtgaaggtgagcagaggaatcagtctatgaaaacttgaagctctcagccccattcagctctcaaccactcagggaggcctgaggacactgaaaggacctgaagaggtaggacctgccgaggtaagccattaccacggcggatgaaaatatccctacgctgtggtggagaagagtcatttttcatctgtatcaggaatggggttctactaagcttgtatttgaaattacacaattgaatcccctgtaagtcatctctgttctctgagcaggccagtgatttctaaatgtagaccacataggatgtggccgaactgccaggatattttcggggacactgaaacagctccttgataaacccctgcatagcctggagcccaacaggagagagtttgagccctactcaaaatcatgttcagtttaagtaacagctaagagttgactgcctcttatggaccatgcactgttttaagcactttaattgatttagtgaatcctcccaacaagcctataaagaaataccattattacatccatttatcccactgagcaaaccgaagaaaatggggcttgagtaattttcccacggtcacggttatcgactgattatttatgtctctccaccaaattcacatgctgaaatcctaacccccagtgtgatggtattaggaggtggggcctttgggaggtgattgagacttaagggtgaagctctcgtgaatgcgattaatgcccttataaaagaggtcccagggaactttgttgctctttcacccatgtgaggataccttgagaaatcagccatctatagcccagaagagccctgtattagtcagggttctctagagggacagaaataataggagagagagagatacacacacacacacacacacacacacacacgtatatgtatgtgtatatatacatatgtgtgtatatgtatgtgtatatatacacatatgtgtgtatatgtatgtgtatatacacatatgtgtgtatgtgtatgtgtatatacacatatgtgtgtatgtgtatgtgtatatacacatatgtgtgtatgtgtatgtgtatatacacatatgtgtgtatgtgtatatatacacatatgtgtgtgtatgtatgtgtatatatacacatatgtgtgtgtatgtatgtgtatatacacaaatgtgtgtgtatgtatgtgtatatatacacgtgtgtgtatgtatgtgtatatacacacgtgtgtgtatgtatgtgtatatatacacacgtgtgtatatgtatgatacacacgtgtgtgtatgtatgtgtgtatacacacgtgtgtgtatgtgtgtgtatacacgtgtgtgtatgtgtgtgtatacacacgtgtgtgtatgtgtgtgtatatatttatatatttatttatatatataaattatatataatttaattatatattaattttatatgtatagttaagtattagctgatcacaaggtcccacaataggccatttgcaagctaaggagcaaggaaagccagcccaagtcccaaaactgaagaacttggagtgcgatgtttgagggaaggaagcatccagcgcaggagaaggatgtaggctgggaggctaggcctgtctctcctttcacgtttttcggcctgctttatattctagccaagctggcaactgattagatggtgcccacccagattaagactgggtttgcctttcccagcccactgattcaaatgttaatctcctttggcaacaccctcacacagacacacccaggatcaatactttgcatccttcaatcccaatcaagttgacactcagtattaaccatcacaaggcccctcaccagaaccagccatactggcactctgatctcagttttccagcctccagagctgtgaaaaataaatgtttgtcgtttaagccaccaggtctactgtattttgttatagtagccagaattgactaagacagtcacacagctaagaattagtgcagctgggatttgaacccaggtgacctcattcttaagagctacatcatactcaagtgaataatgtctctgcttttacaggtcttagttaaaattcacagaagcgttattttctgtgggggtatctaattaagaagtgaactcagaacttggcttgatgtttcagtacagtgtgtagccctgagtaagcaatgtgttatgaagaagcccacagaggaaattttgcaagacaatctatttctccttttacctttaacttggatagtttatttttaaatgaaaaatgctgcctgcccacctgagaaaataatttaggaaaacatttctaccattcttgtttcaatatactttatccaaaatgtgtgatatttatagactacttcaattggggtaagcagtattcctgggttgacttttatgtggggaaaatgtatgctcttaaggcatataaagataccggagcattcttattccattatcttttaattaaattgccctctattatcatcttgagaagtagaattgtgaacttgttgaagcatagaattgggcatccagtacttttgtcataatcactgcatcttcttcaattcatttgtccttcagagctttatctcttttgtgcctttaattaccatctacaactacacccagctttgaaacacagtgctccttccacagggcagcatccaacaggggcatccagtgacatccaaaatattttcagtgaatattctaagcaagaaacagaacagatacacttttctcaatattaataacacacactaagaactgttccatgtaatttaatataaactctcattttattgtgtatacaactgccttcatgtgaaaaatggggccaatgatagaatagtccctttaattcccacatatggttgtggtaaggattcaatgaattcatgacataaacttcatgaacggacttaacacacagcatgttctatcaagtgtcagctcttgctctttttctttgatctctctacttggaggcttcacaagaatatcaaaaataacatatctaaaactgaattcatcctgttccctaggactacttgccatgccactactcccctaacttctctaactcaggaataacatcatcatatcaaaaatctggttgtagggttgtcatctaattattcctttcttgcattgcccaattgcaagtctcagagtggctgcctcaaaaatatatcttgactattcattatcttcacccaaagaaccacctcctccaatttggactactgaaatgccttcctaagtgctctctccaatttcattcttaatcatctcttacctttctcttcatagcagccagagtaatttctacccatgcaatggatggaagttgtttcaatgatgtgtctttctcagatgttccagaacaatgtggaaagcatgtgtgaattgtacaaaagcatcctcatccatggagagcattgtaataaaaaaaaaaaagctccatttaatagttcttagaagcagctgtctttcaaggcatgataccaactctacctcctctagagggtgatggggaaacatagcagttttgagagacaatttaaacactaattacttcaacatgtgtctgttatagttactgctgcattaatagaggcaaataagttgacaggtgattgtaaaatacaagactattttaatataatatgtgttaggatattttacttcagtctacacataatcatcccccatgccaattgactgaggagattcatttaacacttcagagactccaggaaaaaaaaaattgcaggcaccacattttttaacctctttatgagagctttctaaatgaataacattattgtacaaaatgttttaggcaaatatgtgtagagcaaaatacattttcacctgccaccgtatattctgcagcctcaactttttttttcttctagagacagagtcttgccctgtcacccaggctggtgcactcatagctcactgcagcctctaactcctgggctcaagcgatcttccggcctcctgagtagctatgactaaatgtgcatgccaccacacacagcttacagtatattctttatgactaatcctttctacccaaagcagtaaaagaaaaaaataagacaaaaaatgcaaactgctcctcaaatgctcctacccttaccccatccatctgtagcaaagtggctaaaatcatgagctctggagataaatcctacctctactagttactacctgtccaaccataggcaaaattctccattcctctaatgttaaaagcgttatctgtaaagtgaggatgaaaaaaaaatcacaatatgtatttcattagattattgaatggattaaataagttgatatttgtaaagtacttagaacattgcttagcacatagtaaaaaatatatatatttgcttatttttattcctgttgctaaggtataaatgtttgtgtccctgaaattccatgtgttgaatactaacattcaagctgatggtgtcaggagatggggtctttaggaggtgactagataatgaagacggagcccccataaggggataagtgcccttattaaaaaaaaagggggggacactattcaccaactgcagagagctagctagccccttccaccatgttaggttacagcaagaagattggtcctcattggacatcaagtccagtttgatcttgaacttcccagcctctagaaactgtgagaagtaattttctgttatttataaggtaccaagcttatggtattttgttaaagaatcctgaatgaactaagacacctatggtctttattttttatgtgtcaatgcctctgtgctagatgaggtgattaattctataggttgtgtgtgtgtgtctgtgtgtgtttaccaccgtcaaatgctatatttagtatgagcatgcactgttaacagtgacttgatatgatttagtcataaataatattccctggagccaggttaaatgtaaatatgcatcaattttggtaatttgaaatgacttagtcctcaataatattcactcatctttttcttttctcgtttccttttccttctttgcttccttccttccttccgtccttccttttactttccttctttctctttcttttctttcagacagaatcagtctctatcacccaggttggagtgcaatagtacaatcatagcccactgacacctcaaactcttgagctcaagtgatcctcctgcctcagcctcatgagcatatgggactacaggtgtgtgccaccacacctgggtaatttttttattaatattttcagacaaggtcttgctaggttgtccaggctggtctcaaactcctggactcaagcgatcctcttacctcagcctcccaaagtgctaagattacaggtgtgagccactgtgcctggacttttttgctttttgacacctttacatggaggctttgaagtactcttttaatgatatattggataatgtatttcttccttaaaacattaatatggatttagaatatccaaaatgtatgatatttctgccatgtttctttgccaacattttttccatcctgtgaaggggctcaggtttggtatgagtctgagcctctctcctcctcctttattttctccactcttgaaagaatggagagacatagacatatctgggtggtagtgtgggaagaataagctggcatgctcttctctgctcactcctattttcacctgcctcactgtggtagcctttctttgctccagcccttcttatggatggttaacagtgtctatcattcttggggttagggtgtgagcccatttggctctcacactaaacagatgttttggcttccatgttttccctattatttccccatgtttgtccagaatcagataagaatgaggtgctatttattgtgtgtcccctagacattcccaaaaatgtttatgtgactgtaagctcttgcatctgatttttcctgaagtgttgtctcattgagcttctttctgacttatgcaatagccactatgacttttttttcttatgcttctttcaattctgtgaatatatccagttctttttcatttttggcttttacacctgctaatgttttgcctttttactcttcacttacttaacacttattcgttctttaggtttcattttaaatataaattcttcagggaaaccttctaagtcagtctcgtgttattcccttccataccatctaatctttttcttcctatcacttattttttgaaatattttctgtctatctccattatcagattgtaagggccatgaaagcaaagagtgctgtctgtttgcttgactagtgattttttttttattttttgcatcatgcgtagtgccttgcacataacaggaagtcaataaatatttgttgaatccatgaatgacttctgtcttaatttacttgaacaaccacaaattcaacatatactatgtgcaaagaagtcactttgctatgttagttatgtgctcctgccctctggaagactgttttccaatagagccagtagcagcccagcttgaagctatcagaaagtcatcttctccttctcctaacttggggaatttccatgctttatttgacaaataataaccagcaaagtgcacatcaataaagagccacttattaaaagaatgagcaatttaaccaaaaatatctcaaaaagagacttctatgttagattttataaccacatgtaaatcacaacagtatatggaaaaacacttagatcattatatttcatttattttgcatagtttatctttccaacaatatggaaaacttctaggaggcaatagtcctaatttcatctctgtattttttaaatgcttagtattagttggacaatttgtaggtattctgtaaacacatgttgactttactgttcagtactgaaaagtaaaataaggatgttctcattacttatgaactcaaatgtgaagaggagtagagaggcttacatttgaacttcaggcaaaatactcagccactttcccaacccccataaaaatatttaaaaaatgacagatgcctcacaaaataagtggtatcctaaataatttactcattggtatagcggcagctcatttcccagaatctgtaatgacatttgtttttttatttaaaggataagaatacagcagtgctcatgttatcactagggtaataattattgttgcaaaaagcagctcctattcttctggttgttttaaattggggattcagaggtgtaggaagaaattatagattattattctttgcttcttaagtgatgcactctttatatacaactgaaataattaatagaaattcaatcttcaagttattgtgacatattttaggaaatcagcagtaattatttcctatctaatttttataatcattagtaatcaggtaagagtttatcttgttttgaaaattaaattttattgagcttataaactacattacaacaaagaaaaataaggcaattttcttattactaaatcaaaaacattatccaattttttttaactggaagttttcttcgatgaatgaatatgcagatggcatatgaatggatgccatcatatgatgaaaggatccatcatgaaaggatggatatgtagacaaacatatgaataagcacctgatatgttttggatctgtgtccccacccaaatcacagcttgaattgtaataatccctacatgtcatgacatggaccctgtggtaggtaactgaatcatgcaggtaggtttttccagggctgatcttgtgatagtgaataagtctcataatatctgatggtttaataaaggggagttcctctgcacatgctccctcttgcctgccgccatgtaagatgtccctttgctcttccttcatcttctaccatgattttgaggcctctccagccatgtggaactgggaatccattaaacctctttctttataaattatgcagtctcgagtatgtcttgattagcagcatgggaacagactaatatagcatttaataatattctcatctgtatgtaacaaaattgaagttatgcacctttccttgattgattgatatgtatatcaatctattcatatatatagatttatatatatatagcttataactttaatttgtcttaataatcatgtatcacctattgttcttgatattgcaccacaaggaacacaagtgtgaaaaagaattctatgagatctaggggttcatattccagcacaatggaggccatatttacagagactaagttaaactccatacattttccacaaacaaaatttaacaatttttaaggaaatattattaaagaacgctgagagcactccaggttgtctatgcttctactcattgaaacaactcactcctccagtagcagatgagttttaatgaaatgcctgggcaatgtgaggaaatgctttttccttatcagatataacccacaacaaatcacaaaagggtactttttaatagtgttttcagggaacgggtctacccctacccttaggctgacaataatgctttaagcttttcctacatacatctgcacacttaagaggaaagaatttggcttataacattttaaaactcattaattaggatgccaccattacaagggttatggcattcagataatgcctaggctgccgtttccatttgagtaaagtaatggtagtaagtgaacatatactgtccaagataataatgaatatgatttgttgggttgttgattatattaaacataaatacaaaactgaataggacctcctaagggagaccctcagttattctgatattgttctactcattcccttaccttggctaatattttttttaaaacaagcaataagaaaaagatgaaagaatcaacaattcctaccacattgagacgtggaatccttggcctatattacttttacactcatggaagatgttgcaacataatggaaggggcatggacttgggccgcaggaaggacttggttcaaattctggtcctgacatttctagtggggttgccctattttttaatcagtaaaattggactaaaacctatctaaggattagtataaatgtgaaataaatgatggatgtaaagagcctaccacagtagttggcatataataggtgttcaaaaattgttaaatgactcttacattgtagctgttacagacgtaaaattcaatggatagaatagaaaccatttacaatgccttgaaaaactcaactacgtcagatttaaaaactgatttgtataatcacgaaaaggaaaagtaggacaatcacattaaatattgtataatcagactttgcaaattcaatctgaatttctttctaattagtcaaaattagtgaggtatggttgttgcatctcttaactactgtaccacagggtccggtcatcacctgcttctatttatgtttgctgttcccgtaaggaatcctcctaggtacaagtcccattaatagaagctggaacattgcctaaatgaaaaattttatgtattccttacttcctgaaggaactgccacggggtcggtcctaatcagcacttcattttaatacagtatcatcgagttctaaggattaattttataaacgattaatgaaagtacttaattgaatgtcactctctgctgccttcagctattacaggttgttgctctcactgattccagatcgatgcttttttaaacactcagctttgcagtactttaaactactttgcagtctctaaacttcatttagagactcacctgtggctcaaataaaacaatctgggatttgagttattgttgttgttgtttttggaatgattgtacaatgcttgaccagcgacagttcatgttgatttcctccaacagttcatgtttgctttcctccatagaaacagaaactcaaccgggcatggtggctcatgcctgtaatcccagcactttgggaggccgatgcgggtgtatcacgaggtcaggagtttgagagcagcctggccaatgtggtgaaaccctgtctctaccaaaaatacaaaaattagctgggtgtggtggcgggcgcctatagtcccagctactcaggaggttgagacaggacaatcacttaaacttgggaggtggaggttgcagtgagccaagaacgcgtcactgaactccagcctgggcgacagagggagactctgtctcataaaaaacaaagaaagaaagaaagaaagaaagaaagaaagaaagaaagaaagaaagaaagaaagaaagaaagaaagaaagaaagaaagaaagaaagaaagaaagaaagaaaggaagaaaggaagaaaggaagaaaggaaggaaggaaggaaggaaggaaggaaggaaggaaggaaggaaggaaggaaggaaggaaggaaggaagggaaattcaattttgggggttgtggcaaacactacagctaagctgcaagttcttgcacccttacaagtggtcatgtggcatggctttcggccaatgaaaagcctgcttaggatttctgcaaaagttttgctgtccttttacaggttttgccccttcctccatattgcttctgttctttcctcctgcccagagcatgaaggaagatacagtgcagcagctatttttgaattaggagaatgaagactaaggagactggaatagaatcaagattaattcagcagttaccataataggcagcagcatggatttggcccatagacattatttgctgacccctactatagacaaatggattaagttcagcccagaatcaagacagaataggaagggaaatgataatacaaactgtgcaactgcagaagaggagaaagggtgcaaaatacattaagaacacctgtgtccacagctcactcagtgacggaacatcaagtaccaaggatatgtacaagttccagacagtggttaaagcacacttcctcaggttaagataagttcaggaagtggaaaagttcacactacagctgagataattcagttttgagataacaggatgagttggagctgaaactaatggaatgtgccataaaattgtatagaaatcaatcttagttttttttatcttctttttcttcaaagagggtttgttataataaaatattctcagacctccttctatccttgttatactttttaagacaccctggatggtagtaaatccttggattccatttcaggatataagcagaaagagatgggaagagaccatgaaatctctcaagagagaatgtcaagagaggcattatcatcattatggtctctcttgcatgatctcaggtattatgagataaaatacaagtgtactattgctttgtgaatctgaggctatctggcctttcttaacatgaaatacatcatggcatgtcttgaaaacttaagctttgatcatgttcagtgaatagagaggattgaacgtttgatcaatctaatgaattgaaacacagttcgcgaggaactctgaagacttttcattctgtcatcattccactatgtggtaaataatagctagcacatattgatcacttattaggcatcaggcactttgtagtgcgctgtatacagtctacaattgagcgcatctaatcttccaaacagcagtataaggtgtcatgaccatgctaacttttcagacagtcttatagggaaagggcaagtttcttaacctcaatttgtatgaagcactaagatatttcaatgaatattccggatcaaatgtgtttctccttataatttttggtggcaaaaaaaatctgctgtcaaatacataatgtacttttgtttcctaggttatacagctctagctacagtcttgagccctacacaaccctgaaactgggagtaaacaaatgtcacaaacatgactgtattattctttaaaacattttatttacaattcagtttggtgagtagttgtctttaaagtttttattctttaaatatttgcttttctttctattttataatatatcaatacttaggaaaatacagtctgaataaatgtgtataacttttcaaaataatttttaagataccagcaaaaatttggtaaaaattgggcaaataattgttgatataatatattaatgcacaaggaaggcaacgcatagaccatgagagctctcagctctttgtaaatgtcttaaaagctacataggactcattgtttaagctaattctatatcattggataaggagttatcaaaagcttccaagtaccacaataaaataagtatattaatttatttgtttattcattcagtaaatatttattgataatttttaaggatcagactaaacaagatggaccaagtcctggctttctcagcacttgcacatcaacagacagctgtgtccacaatcagtaagttgaggatggcaggacagatcaccagagcataagcaaaggtatgagctacactcacagctaagacactgaactatctgccctgggtctaagcaaaggccacagggttggttttccagaagctccaagataggtgcatgtatatccagatccaatgttcacagcttggaactgtaatctttaaaagctaagttgagggctcaagtcaaaacatttctctcccaataaaaatcatgactacttgcagaaggaaaagcctggctatttggtttttagggagtcaggagcactaacctgctctttcagcttgcaagcttgcaattctaggcttccaagtgaaaaccaacctgcttatcttgcctcatctagaattagaggggtgacagaggaaattgggaagtagttttgaaagctgcagtgccttccttcctttccttctttctctctctctcttttcttccttccttccttcctccctccctcccttcccctccccctccctccctccctccctcccttccttccttcctttttctttctttcttgacagtctctctctgttgcccaggctggagtgcagtggcacagtcacagctcactgcaacctccacctcctgggtttaaacaattctcctgcctcaacctcctgagtagctggtattacaggtgctggccaccatgcctggctaatttttgtattttttagtagagatggggttttgccatgttggccaggctggtctggaactcctgacctcaaatgacccaaccacctgggcctcccaaagtgctgggattacaggcgtgagccaccgcacccggcctaaagctgcagtttctttaacttgttatttactataatgtcaggaaagggcaagaatcttgaatctgaaataataatgatgacaatggggttgaaaaaaagtaaaaagttattgcctggaggtaagattattttttttaacctagtattttaaatatattattttattctactttaggtgttaaatacatgaagtagttaattgtcagcaataatataatgtaaagtcaaagtacaagaaagtcttatgctttcaagccttgatgtaaaaaataattatatgaagtaagttaggaatgaggtgggtaggaaattgagggtgccttgctattttcagcaactgtcagagtgttcggtgcatgatacatattttctgaatattttcagaaaatcatttctgatgtgtcagtatactttgagtcttggaacacttaactgcaaaacgaagtcgctgtgatagagaaaaaggaatatgtatatataaatgcagagatataatgagatagatgcacatttacattttgaaaatcaggttttcttcactgcaaaaatatgtggggttcttctgaggttaataattattacataagaccaatgataaaactgcatttctttgttatgaagcctaagatattaggtgtgttttcatgcaattgcattttaaaaacaattcttgcaatcatcttattttgtagtgatgttcatgaacatacttaataatagatacattttttattacaacaaaatactactttaataaaaacaccaagttatttcgaaatgcacaggaaaagtttctctccattgttgtgcatgctgaaagaccacagtgggaagcacacaggcagagggaaatctcagaaatatgaactgtaacaccacacatagcagcattctggtctcacaagtcagtagatactttccccactaaaattttgtttcaataattaatataagcttttttcatctgaagtatctctaaatcagagaaggttaaaatcaatctgtatgtatgaacttgctgacaagctagtgtagccacttgcctttaggtttttattattttcccagtggctgatgggcaggcagcagtgttaagcctgctaactgaaacatattctaaattatatggatctctggaggggatgcattctacttaaccttggcgtttgttttaaattacaggaatctaccatattatattatccaagatttttaaaaatagcttttattccttttctaaattgcatctcaaggttgttagatttcctattaaaagctaattaattaaagagaaaatacatacatatgtgtgagtgtgtatatatatgtatatatacatatgtatatatatactcttctacacctgccagccagaaccaacaataatattgtcccaagctatatagtacctgcttccaaagaagtttaaaatccattttagagagccaattattgatgtttaaagtctgtaaatcatgaaggtagcaatacttctaagtatcaaaataaaagctatgaaatgccatatcatgaatatatgctctctcacttaaactgttagaattttcattttttaaataaattttattgtatgtatttcaggtatacaacacgatgctattcctgctctgtttgctattcaaaatctcccccttttgaaataatatcactaaaaggactaaaagcaaattgtttgcttaatgggttgactgatttttaaagactaaaagagtcaaatatagatgacaccaaaatgtggtccagaaccaatagcttgtctagcctgaagaccggatgaattattttaccccattttagaccatttccatctgttatttccaacacaaattaaataagtcacaagaaggtatcatgatcaaggatacctttctggagaatagccatgttgattttaaactaacagaaatttatttgtggggtaagtatggatacttaataaggaaaaacagaaaaaaacttttaatagtcccttatttatttcaggtactgtgttagctaggtattttacttattccttctcagcgaatactataaaacccatttattaagaaattgaggctagacgatgtaaaagaaatgaatctggaccaattcctgcaaatcatgttaggaagttacaagaaagtaaaaagattcatagtcaatcaagtgctgtgaatagccattgagctctggaaagccatagaagcagacacattagatacaggatagatggttcctgtagaaagctttacagaaactgaaaaagcctaaagctacttaaatgatggtaacagtagggtagagtagtacttaaccatatgacctttggctagactactgtatttgaattacggctctgtcacacactaaatatatgattattgataagttattcaccatctcagtgcctcagtttccttctttataaaattgcaataggacctactgtataaaacctgtgataatttggtgtcaaatgcacataaaacatagcatagcaatgtgtataaagtacacatatatcaaatgttagctctaattatttctgtgaagacaaatatattgcttgtggaacacatggggagatcgatgttgtctttacagacactgcagtgcactagaagagcatatcagtaatatcttgttctttaaataaattactagcattcatatggtatttatcctgaacagggaatatgataaagacttttatggattttattttcatttaattttaatgggattttgatgaatgtactattcccattttgcaggtgaggaaataaaggtaaagtgaatcttaagaagttgcttgagtccatagctgtagtgatagtgcccatattgaaaaccaaatcatctgataagtccagttcctgaccactacattatggtgcctttctaagggataatgtgacacaggtatagaatggtgacaattgtagccataagtgccctttccattttcagccctccagtgcttcatgaagtactgtgttcatgaggggctgctgaatgactgcctgtaggacacatcttcccagagcacacaccctggcagatcacagcccaggagaaccacgagcccatctgaaacctcagaaatagcccagtgcctgcaggggatggtgctgcagcttcagacaggacctccatgaggggcagaagtttggtgaagtatccctgatcacagtcagcttcacatcgtagggctttgaaacatgatgctgtcaattcatcttgaattgttcaaggtcaaactcaggcattcaatgctgtatcgttcctctccactcaattccatccctttccattccatctcattccattttttccattcgctccactgtattccattccattccactccactctactccattctgcgcaaacttattaactacttactacactacttagtctgtaagcaaaaagcagctgctgctctaaagatgaataaaattaggcttaacacaggcttaaattaggcttaaatcaggctgaccaagttccattcagtaggcaagtttaaagagccaaaatctataattttaatacttttagctctaaagctagaattggacacagtgttcttccaatgtatagaaaagtctactcagaaggctttatttttgaggacttggagagagttaaataaggtattttcgacatatgttttcaatgaagcatgaaaactagaaaggtgtgtttcactggctgaggatacttcccggtaagactcaaggtctaccatctcaaattagagttctctcaaaggtgctaaactctactgatttttttatgaatcgcatgtttctatattttttttgccaaactctcccttctgtaaagaaccatgatttaagctagcaacgacaaatgaagcatagttaccctcatttgatttgcggcatttcagactcaactatttttctgaaacatctattttatttcaatagagacaagaagcctgctagtttccttaatcctgcgttttaaaaacatacttctatatgaattggagaaatgaaatgtgctccatagtttatgttattccttacttttggaatgtatcctaatctcaggattcttcattactctgactacatattatatttatttccatcctaaggtttttcaaagataggcatgtggattatctagatcaacaatccctaaagggcttttaaaatgtcaattcctgggccctactccattcctgaaaatcaaaattttgaagcagaaatctgagtctccaaatcatctcccttggtatatctcaccttctatctccctttgcaatcacaagacagtgaccaggtccagtgatgatatcatgggctgtctgtcacctgcctgacagtgattcctggagactctcacccaaacaaactctcacagaaactaggcaacgtaagagacaggaaggttcagctggggaggcttcattgcgtcaggaatgccttatataattccagaaggtcaacaagagaaaaccaggccaacagagcataaatgtcaacatttatgggcccagctggtgtcctgctgaggctacgtatttgagattttgcaagccaggcaatattgcaagttaacatgctgtatagattctgattctgcaggaaaattctccttcagtgttgcatagttgcatttactaattctgctttcttagtattttgtgtatttgttttactttgtattttaagtttcagctaaacaaatgacaagtaaccaaaatacgaatgaaaggactatttcctatgcagctactgtgtttacatatattacctcatttaatatggttaacacgtcagggcacggtggctcaagcctgtaatctcagcactttgggaggccaaggcaggcagatcgcttgaggccaggacttcgagaacagtctggccaacattgcaaaaccctgtctttactaaaaatacaaaaaatatagctgggtgtggtggtgcgtatctgtaatctcagctactcagaaggctgagaaatgagaatcgcttgaactcaggaaacaagggttgcagtgagccgagatcacgccactgcactccagcctggctgacaggatgagactctgtttcaaaaaaaaaaaaagtaacactttgagaataggttcttattatctctatattaaaaaataaagcaaacaaaacgaacagtggataattacttacccaaagttaataaatcttagcattggatcttgagccctgtttctttcaaagccaaaatctatattttattctattacactctgctgtttccaaaacaggccaaataatttctacccctcaaacatttaccagtggcagaaaacaactatgaaatcacactgaggccataaagtaataagaggaaatttctataaagccacacaaccatctcatttccctgtggccacactttacattcattcaatgaagaatcaggatctacactgcaccacacattgggggctgaataagcacagacatacctggtaatctttgatttctcagactctacaggagatcaaggttctggcaaatgtagaagtacctcaaacctttctggtcattttcaaacttaaattctgtatacagtacaagcatactgttgagggtggctttaatgtgtaaaactgctgcttatggatagtggcgatgggtgatgttgccacacctcatcactgcatgccatttaataccttttatccattaaagttcaggccaccacatcagcactacaatattttaaatccttatatctgaaagtacaggaacctctccacttttctgtgtgtataatgtagcccttggcacattgcggaaaacaaaaacaaagaaaaaatacaaaaaaatatcaccatctgtactgggttgaatagtgttccttaaaatttcgtgtctacttggaatttgtgaatataaccttatttggaaatagagtctttgcaaatataatcaagtcaagattaagtcatactgtattagagagggccctgaacccaatctgacttgtgtccttatcatccttacaagaagagggaaattgacctggcgcagtagctcacgcctgtaatccctgaactttgggaggccaaggcggccggatcacgaggtcaggagatcgagaccatcctggtcaacatgatgaaaccccatctctactaaaaatacaagaattagctgggcttggtggcacatgcctgtaatcccagctactcgggaggctgagtcagaagaatagcttgaaccagggaggcggaggttgaagtaagccgagattgcaccactgtactccagcctaggtgacagagtgagattccgtctcaaaaaaaaaaaaaaaaaaaaaaaaaaaagacaagggaaatttggagatggagatacagataatgaaaagaagggcatgaacagatggaggcagagattggagcgatgcatttataagcctaagaatgctaaggattaccaccaaccatcagaagctagaagagataagaaaggagacttctacagcatgtttagaagtagtatgtcccaccaacaccttgatcttagacttctagtctccagaagtgtcagatagtaaatttctattgttttaaaccacacagtttgtgatactttgttatggtcaccctaggaaactaacacaccatccataaatatccatgtaccacatgcaaggtgctatgctcagcgttgagaatatggaacaatggagaggtatacctggaatctgggacacgtatcagtgtctatagacatagaggaggaaggtaaaagagtgttccacttcattttaactccagtgtgttgcttcttttctaaggagccacagacaatgacttctcatcctcctcttcctcattattccttggcttacaagctaatgcatacatcatggggttcccagtatttccttttccccccaatattttatgccccatgcttgtgtttatattgtgatataataaaatggcacgaagtagaaacacacccttcacatggagcacacattacccagtggttttattaagacttgtgtttcggcatctgagctatgtgaaatctcactcaaggctctgtaatgccggtatgttctctatatgaatgtggcacgactgaaaacataaaactgttatcacaaaactgttacatacattgtaaaacaaacagctctctgatgtggtttggctctgtgtccccacccaaatctcatctcaaattgtaatccctgtgtgtcaagggagagacctggtgggaagtgactggatcgtaggagtggattctccatgctgttctcctgacggtgaatgacttctcacaagatctgatggcttaaaagtggcagtttcccctttgctctctctcgctcctgccgccttgtgaagcaaggacttgcttctccttctgccatgattgtaagtttcctgaggcctctccagccatgcagaactgtgagtcaattaaatctcttttatttataaattacccagtctcaggcaattctttataacgtgtgaaaatgaactaatacactctcaaaatccatccaatgcataaaagcaccatttgaactgccacaaatgcaataaggcctctgaagttttctagttccaccctttccatcacctcagctaaagtatcttctcctaaactccaggacctccttttgtaagagtgagaattcctaaattaaaataaccaacagaaagtgccaaagaaggaagggagaaagggagggtgggatggaaacaaaattgatgagtgcagttgtaagtttcagggattctttacattcctaacattggtttatttggtattataaattaagaaaatttaaaaattatccataatgcccaatgactttgtttacagatttgtatcagatcttacaggaaatggatcactgaaatagtcatgtccagattgagctgacatttactgagttccccttccacttcaaactcagtgtcagataccattttatatgctgtgtaagaattcttttgtgaggccgggcacagtggctcacgtttgtaatcccagcactttgggaggcccaggcaggcggatcccgaggtcaggagtataagaccagcctggccaacacagtgaaaccccgtttctactaaaagtacacaaattagctgggcatggtggcgggcacctgtaatcccagctactcggaaggctgaagcaggagaatcgcttgaaccgggaggtggcagttgcagtgagctgagattgtgccattgcactccagcttgggcaacagagctagactccttctcaaaaacaaacaaacaaacagacaaaaaaaaaaaaaaagaattattttgtgcttatttacacaagctcaaataggagtgaacaaagttttattagcttgtatgtagtcacgcattattataaccaatattaatactgggtcttaaacttaattaggccttcagatttgaaaatctcaatatttctttctactaaaccatgtggcctcaccaaatatatttctgtatgaatcctagagcacatgttatcttgggaggagtctgttttttgcttttacaaaacagtcatattgccaaatatttaaaagaagaagttctacaatttatagtatacggtcacactgtcacctgacaacctttaataacaaaaatagacaaccttacatgtacatagataacatttcagcaacagttttctaacagtgagccacagctaaaattgtgagcatgggtacttcagcatgaaggctcaaatcaggagaatacgtacaagagagaggctcatgagaatttaaccttaccttgcatttcccctaaaaacaatggctctggattcaccaattcagtgttcaagatgactttataaaatataactaccctaaataatgatgattcactgtactttatcttactcttaaacatgtacaaattttagtagcttatgaaaggatcaaggtaactcctgtagaaagaaaaactagtttaatcttgtttgatccattatttaccaaacgtttttgactacagatctaacttataaagaatacatattatcacctcacaggacaggaatgcattgtttggaggccctgctgtaggtgttcagaggttttttcagtccttcttttgaggccacatgatctattatttagagtgttttaaagcatcactcatgaccataaatcaagagatgaggcctggcacggtggctcacgcctgtaatcccagcactttgggaggccgaggtgggtggatcacctgaggtcaggggtttgagaccagcctgtccaacatggtgaaacatcatctctactaaaaatacaaaaatttgccaggcatggtggcgcatgcctgtaatcccagctacttgggaggctgaggtgggagaattgcttgaatccaggagacagaggttgcagctggccgagactgtgccattgcactccagcctgagcaacagagtgagactccatcacaaaagaaaacaaaaaaaaaaaaaaaaagagagagagagagagatgaaaaaattacagagatcctaagacatctctcatccacttggctatcaatatcaacctgagttggtactgcagtctgataaaattcccaacttgttctttgattagtagtgcttcagccttatcccaatttattgacattcctatgctgataaacctactcttacccttttcctttccctgagggaatgtttattctagtcttaaacttgagccaggcagtcaggctctgggagtgagtggagagttcactgtataaaagaatgtcaaaggtaacctttaaggaacgctgtgccacctccagagtcagatttatagtgaagttaacgaagcttaggcttcagacccctccactgcacagtccagtatcctacccaataaattctagcaaaatgttcaagtcatatagtcttataagctttctatttatttcttttcttttcttttcaagacagggtctcactctgtcacccacactggagtgcagtggcataatcaccctcactgtagctttgacttcctgggctcaagtgatcctcctgtataagcctcctgggtagctaggaacacaggcacctgccaccaggctcagctacttttaaaatttttttgtagagatggagtctccttatgttgctcaggctcatcttcaactcctgggctcaagcaatcctccaacctcagcctccaaaaatgctaggattacaggcatgagccaccaagccccgcctaattttctaatatttagaaagtaagatagtttaactataattagttaatactgctccttttctgctacaagttttctatggcacgctttctttcatatcttttagacttgaaggcaactgtggacatttttagaatgcagctaagtaagagaacatgtagttttatttatgggttcatagctttttatgtacagtcaggttatggatgagtgtcctagggtaggaatggcttccacagatgtgtctaccacccaatgtgccaactcatctagtgtcataattcaaaggcgacccaaaagtgaaatgagcatcactggaagtccccaactctggaagaacaggaatagtggatggactgctcatttcaaagtcagttaagcctaataacttagagtcaaaaatattttaaggcttcaaaaatatatttttaaagacttgaaaaaataactcaaataaaatcgagcttgaaaatattcaaaagcttgagaaagctcaaatatatcattttaattacaatttataaacatgttttaaaatttcaataaaatagcgaaaaatataaagctcttgattaggacgttatgaaattacctttattgatatttataaagcaagttattaaagaagtgtggtagaatttagattaaagtaataatacaatgtaaaacaaaagtgatcaaaataaaaagtgaaattgtgaacttacgaattacgttgcatgaagaagaaagttgtaatagcatcaaatatatataaaaatatatatataaatatatggaacacaccaaaagaaacaatcattagtacaagagagagaaatttttacaagaagtaatgaagaagctcttggattcagaatagtgaatctaagtaacaaagaggaataaataatgaatcaaataattacattaaaaattaatttcatgttgaaatgaaacaaagtactaacatttattaaaataacaaaatgcaatacaccaccaaaatgagactatcagaagtaaactgttcaatgaatactgtcaattcaatgatgattttaaattaatgtacaacaaagcttaaaatgtcatgaaatattacaacttacgttactaaaggaaatcaatagacattcccaaatttgacaacaatcctaaaaatgtatataatattacaaataatgaattatgaagtaaaataaagctttcctattgacaataaaaaataaatgtttatcaactctgtgataagcctgaattatttttctatcttctatactaaaagtagtgcaaaatcattcaactttatgcaagcaagaaccaggaaaactatcacacagatctataaggcagctattttattttagaatgttactcttttaattttttcatatgtatatcatttgtcagttttctaaaaactgtaatttcaaaattgatcattcctaatcctaactattcatttttacacttagttttatattttaagcatgtatttttttttcataagagaatcctaaaactgtgtaatctctggaccccatgaaacctaaatttgctctacaatagaggtattagatgatgtaagtaaacttcaaagccaattcaaaaacagggacctaatactgtttatgttgtttgctttgttgtagctaatatgtcagctgtgaaaataagtaattcaaaatttaagctgctggaactttaaaatattttgagcttaaagggaatgtgaactaaatctcataagcagacagttgtaaagtcagcaggtgtaacctttgtttctccgattacagattagccttttccttacctacattgtcttgtaaaatgttgcaaatgactaaagggtgccagggaagaagacctttttccttttaagtgttgattttcattatagattaccttccatctttcttctctcacacatacttcatgactaccgcattgtctacgatggaatgttaaatatactcttaaattggaaaggaaataaaaataacctttatggataagaaaacgaaccataatttattaaattgttgtgactcctaaactagccttgtacaaaaaatgttataatactgttaaattgatttattttctgcctatataagcaagaccttaacttttaacatctgagtactgatcccatttctctggagttcatattttccggatggtctttcccagctttttgcatgaataaactcttcaaacctggattctggtcctttcaattatttcaggctgacatagcattgaaaaatagagtaccactgacctagagtcagcctatgagaaattctctctctgtctctttctctctctctctctctctctcacacacacacacaaacacatacataaaaaatttaagacattgtattaactttatagctccacataacaaattaccaaaaattgagtagtttaaaataagtatctatttattatctcacagttctgtaggttggacgtctggacacacttgactgggttctctgctgagaatctcacaggctgaaatccaagtatagctggctgggctcttatctggaagttccaaggactaatccactttcatgctcattctggttgttggcagaagccaattccttgacattgtaggtctgaggtcacaattgcattgctagctgtcaaaccgggtgctgctctctgcaaccagaggctgccctgcattccttctcacacagagcctccatctt

SEQ ID NO: 364 - DNA, 969080 bp, Homo sapiens
aacattttattttgcttttattttttctttttgaaatacaaaatgtgcacattgagtttacacaaacacgtgatggcaaatttcagtgtacatgtattgtactactcttaatttctacactggtgatagcagggcagctttcaacatcctatctctacaccagaatagatacctgatttattgttgcaaagacagttgcaaatttcctccttctgtagcctcttggtctttgtgatatttctacaaaacagggacgatgtgtgtggctttagtaatgtggcaactttacagttttggctaagatgattaaaaataatctgaattatgatgagctaaatcatactgtaatctggattagttgttgagcacttattttctactaaatcttggtagtagttgtcaatgtaatggaaccactggtgctttcaaagtgaattttgcttgctaattttgcttgctgtttgttcttagtagacagtggggtagtcaaggtttctttctttgtccctgaatggcttgtaatataaataaacatgctgtaaggaagtcaggggaaagaggacagatttggcctttaatgctgttaggattacttgttattaagcattactatatactggaggatagatatcctgaccctttgcatatgtctgtaaacatccttgttttgtttgatgccttcttcaacttccacttaatgattgatactaatgattgatacaatagaaaacagcctgtaagaaagattgaacaaatccaaaattattatataggccttggctgtaacatattatggaaaattaaatgcttattaaaataagttttattaggcatatgctgatatctgataataaactaatttttaaatgtttaataatttttaaatgtttaaaaatgccagataaaactaatttctaacagaaggtgggaaggccatagaaactggaactatgtgtttttttaattgttgtaatcttgtttccttaaagtatataaatggaatttaaatggaattacagcattcaaacatgaaaattaatttaatttctggaaattaaatgcagatgtcactatattagaaaaccattcaaaatcctaggactgaatacatacaaatgagtagcaaaaaacactgatattttaaaatcactgatatgtgaaagcctcaataatcccatggctaaggaaccaataaaactatatgccagattctattacttttgaatattcacagagtatgaaatgagttagaccatcccctgaactcagtggcattatgaaaaggatgcaaatttataactgaaagctcaaatcttttggggattgctttatattaaaacaaagcttgtttgcataatatgcttcagtgtcaagctgagcaatctatgctaaaagtggtagctccaactttaagggtggtagaatagttcacatttgtctgttggattcaggatctatttgacaagttaaatcacattttcaaagagctgcatggagcgcattatgttttcatcctgtaagggagaaacacagagcgattaaattcagcatatctgcaaggaaaagtacactattttgcccctgagtattgcctcctcccatcaaccacctcaaccacctatgccaaaagctcaaatattaagtgtttgcaaatgtaaatgccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctgggattacagttgtgagctactgtaccaggccttaacaatttttaactgtggttctgcccacacatcaagtcaaataattctaagtaagctaacactggtttctttgataacaggctactacctggagttctcttcagagaaaattttccactgtttattttttgtgactgaagaccattagtgagttcagtcaaagagccatttcttgtccacatacactaaaacaatgacttttctcttagaaatcagatagaagcttggcctgttgtgatgccatacttggctatctaggaattctaatgctgtggagatatgatagataatatatgagtgatgctaagttttggcaaagagcaattcaaatctcatgtatgttttatcctccatgaatactctctaaggaatttgggaatcaacacagtacatgtacaacttttgtatccccagggtttcctccatagcctgactcagtgggcactctaaatgttgattatgtaattggtgcttgttttcagagtggtaggcttatgctgcatgttgtagaagtggtaaacttaggcatatgatctctatatttcgcccagttcatggtagctagctgctaatactcagtttagctgttatgatagctgaattgatagttattacactttcattacttactttttggcagctttcaatgaactcatctatggtaacaaccccatctttatttttgtccattttctgttcaggaagaaaacaaaaattgtatttagacttatcccttaataccctcacacctggaccaaatgagctgaagctgataaaaagaaaacctagctgcttatttatttcacgtggaggaactgtttcagagcaggaaccagcagttttttagagataaaaatgatagggccaaatgcttctggcttttcccttttcaatataatgtggtgaagatgtagagtcactctgtcctaggtaaaatcccaccttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagtctaatttttgccttaccactttcattcttatgagagtaaaaataatctctaataacttaaacatttagatttattgttgcacatttgtttcacgtgaaagatctctcaattaggttaatacagagcgaatatatatttacttttaagagtattcaattataaatgatagagtaatttgtaaacaggtgaaaccttttaagatgttttaagcatagataagtagcaagtagtttgttagacacaggcagaattcttgagatgtgttaaacacagaggtaagaattgaagaacaagagatatttaaggtatcctaagtatctgggtaataaatattcatgatataaaaatatacaagaagcactatttaggatatgctccatatacatgaacacaatagccataaggtcttaatttggcacccactagtgatacctattctggccccaggtgtcctctgtgcaagaaacacaaatgaaacccattactacttatcaggctatactcgtgacctggcacacttgcacctgtgtctctccagtagcgcaagttcatgtcatttgctgttggccctgggcaccttttgtctgtggggcctcttgctcaaaactcaattctggggaagtctcgtgaggcaaagagagacaggacataggcacactgagaatgcccaggatttagggagtggtctttcaaccccatttgcagcctgtcctgcgtggttaacttactccatccctttctttacttctcgctgtgttttaaattggtttaataaactgtgtaatacgagtatcttaatttggtctgtgaaccttgtttcctggatagtctgcctcaacgtgcatttggagaccccaccattgcgtcaggtcattccacaatccccatgattgtaaaatttcatttccttatggatcacatgctgtggggaaaagaaaggcttcaggctaaatgttgaaacatgggttggatacattttctttctatctgattccaaccatgatctttattccattcacagtatttattaagatgccagcaggaaacaagggtgtaatctttatgtgttatatatttactttggagcttcaccataaactacttctatcccaagtttttaattgtacatctttcttccactacataaaatattttggaatttcctcaaaaaaacttttcaaattaataattgcaattaatattttaaagttaagaaatgaaaatggtccaaattactgtgatgttggtgaggcatcccttacctctttagtgatgtagccatctttatttatgtcatacagattaaatgcccaattgagtttttcttgtactgtcccccggagcaaaatggaaagacctttgatgaaatcctgaaaagaaataaaaattcaattttatatgacatttttaaaaaaacaaaaacaaaaaaaacaaatgatgtaagtaagggctacaaccctctggatcttgaacatttagcaaaatgattgatgtgttattggttgtctagttttcagacttctctgtgggcataaatcactccttagtcttaacattttcatattctaattggaaactgagttaaatcaatggtcatactggaaattgtaccagtgcgtacccacacagctagaggcttgagtataagtggtattggctttccactgcaagtgcacatgatttactaaaagaatctaataatagttttttcaaaaaaatacaagtgcacacataacacacttcaatgaaaaaccgtttgctaataagaaatgtggctgtccataaaagataaaccaattgtggtctttaattagaaatccagttataatttacatgtggacagtgggtaagagcatggaactggaaaggacagactgcctggattcaccctccagctatattactggatggctttgtgtcttcaggcaacttaacatccctttgcctcaattttcgtatctgtaaaatggagctaataatagtatctacctcttcacaattttatgaggattaaaaaagaggctgcttataacagtccttggcaatgacattggctatgtaagtttttgttaagtaaatggagccctcagtttgtatcctggttagattgcattgcagactggccagattaacttgattaaattcatttagtgtttttttttttgtttttttttttttttttgagatggaatctcgcactgttgcccaggctggagtgcagtggcacaatcttggctcactgcaacttccacctcccacctcccaggttcaagccattcttctgcctcagcctcccgagtagctgggactacaggcacccgccaccatgcctgactaatttttgtatttttggtagagatggggtttcaccatgttggccaggttggtgtcgaactcctgaccttgtgatctgcccaccgccgcctctcaaagtgctgggattacaggcgtgagccaccacgcctggccagatttcttgttgttatgtacagcagggttaacgttacaatgtgctgtattcagtttataatccacttttaggtaggaatgaaagcagaggggaaatccaaaagtcttctgggtgaatttgcattatatctccctttctcacattccttccttttatagctgtatttctatctgaatttctcaaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataattgtcaaattcatattgcaagggaccctgaatagcccagtcaattttaagaaagaaaaacaaacttggaggactcacactgcccaatatcaaaacttagtacaaagttacattaatcaaaacagtgtggtactggcataaagacagatatatagaacagtagaatagaattgagtctagatataaaccagctgtctgtggccaattgattttcgataatggtgccaagaccattcaatagctatggaaagaataatctcaatatatggtgctgtggcaactggatcaccatacttagtttgcttcccattggcatgaagggtagaatgtcaagtgagagaaaaacaagattccagagaaagccacaaggaattccaatatttggcaggtacagagaggagaagctggcaaagcatcttgaaaagaagttgctaaagaagtgagtcaggagaacagagcatttccctaggaaaggattgttcattttgctccaaggttggaaaaatgttcactggaccagcaacatggaggtcaccagcaagtgatagggaacggtccagtggagtaggagtgaagagtaatttttaatgaggagcactttgaatactgaagagaagaatctaaaaagagtaagagtcagaaatgggctgtgctcttgagaaggtggggaggatccagaacatgggtagatgggccgatctgagaagggagttgatacatgagacagaagaacatggtgtggatgccagcagctgctttgcaggtgggaagatgactgtgtttctgtccgatagctttagtgagtgtgagctgtttgagagtgaggagcctggtagaagaggtaagaatctgaggtttgaggagagaggcagaagctctgatactaagcagtaagatgacatgcaaattagagaaagggagacctccctcaaattatttccctgccatattttagaaaattatttatgacatagaatgtagtttagttaaaaggtaatgacagcccttggaggtatgagtgtacatcttgcacaaccagcaggctggggatcatggctcatgcctgtaatcccagcactttgggtggtggaggtgggaaggttgtttgagtccaagagtttgcaagcagcctgagcaacgcagccagatccaaattaacagcaagaaaaacaaattaactgggtatggtggtgcacacctgttgtcccagctacctgggaggctgagatgggaatcacttgagcccagaaggtcgaggctacagtgaactatgattgcaccactgtgcttcagcctggatgacagaccaagactctgtctcaaaaaaaaaaaaaaaatccttagctttttcagaaggcataaaatatacattgcagaacatagagccttattcaaggaagattgctgagcagttttgaaaggctagatgagattgattgttatcaatgtaaacgatatttttaaaaattcacagcgtagtaataatatgtcattaattgtaaggggagctggccacagggtctttgaaaacatgcttagagtattggttctcaaaatataatgtgcaacacagtcacctggggagtgtgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcacccaggaagcgcaaggggttggggaattccctttcctagccaagggaagctgtgacagatggtacctggagaatcaggacacttcctgccaatattgtgcttttccaacagtcttagcaaacggcacaccaggagattatatactgcacctggctcagagtggcccacacccacagagccttgctcactgctatcacagaagtccgagatcgaactgcaaggcaacagtgaggctgagggaggggcgtccaccattgctgagacttgactaggtaaagcagccaggaagctcaaactaggtggagcccactgcagctcaaggaggcctgcctgcctctgtagatgccacctctgggggcaggtcatagctgaacaaaaggcagcagaaacttctgcagacttaaacatccctgtctgacagctttgaagagagtagttctcccagcatggagtttgagatctgagaacagacagactgcctcctcaagtgggtccctgacccccgagtagcataactgggaaacacctcctagtaggggcagactgacacctcatacagccaggtgcccctctaagacaaagcttccagaggaaggatcaggcagcaacatgtgctgttctgtagcctctgctggtgataaccaggcaaacagggtctggagtggacctccagcaaactccaacagacctgcagctgagggtcctgactgttagaaggaaaactgacaaacagaagggaatagcatcaacatcaacaaaaaggacatccacaccaaaaccccatctttaggtcaccatcatcaaagaccaaaggtagataaaaccagaaagatggagagaaaccagagcagaaaagctgaaaagtgtaaaaatcagagaacctcttctccaaaggaacgcacctcctcgccagcaatggaacaaagctggatggagaatgactttgatgagctgacagaagtaggcttcaaaagatcagtaataacaaacttctccgaactaaaggaagatgttcgaacccatcacaaagaagctaaaaaccttgagaaaagattagacgaatggctgactagaataaacagcgtagagaagaccttaaatgacctgacggagctgaaaaccatggcacaagaactatctgatgcattcacaagcttcagtagccattttgatcaagtggaagaaagggtatcagtgattgaagatcaagtgaatgaaatgaagcgagaagagaagtatagagaaaaatgagttaaacaaagcctccaggaaatatgggactatgtgaaaaggccaaatctacgtctgattggtgtacctgaaagtgacggggagaattgaaccaagttggaaaacacccttcaggatattatccaggagaacttgcgcaacctagcaagtcaggccaacattcaaattcaggaaatacagagaatgccaccaagatactccttaagagcaattccaagacacataaattgtcagattcaccaaagttgaaatgaaggaaagaaagttaagggcagccagggaggtcgggttacccacaaagggaagcccatcagactaacagcggaactctcggcagaaactttacaagccagaagagagtgggggccaatattcaacactcttacagaattttcaacccagaatttcataaccagccaaactaagcttcataagtgaaggagaaataaaatcctttacagacaagcaaatgctgagagattttgtcaccgccaggcctgccttacaagagcttctgaaggaagcactaaacatagaaaggaacaactgataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacagagacacaaaaaacccttcaaaaaatcaatgaatccaggagctggtgttttgaaaagatcaacaaaattgatagactgctagcaaggctaataaagaagaaaagagagaagaatcaaatagatgcaataaaaaatgataaaggggatatcaccactgatcccacagaaatacaaactaccatcagagaatacgatgaacacctctatgcgaataaactagaaaatctagaagaatggataaattcctggacacatacaccctcccaagactaaaccaggaagaagttgaatccctgaatagaccaataacaggctctgaaattgaggcaataattaatagcctgccaaccaaaaaaaagtccaggaccagatggattcacagctgaattctaccagaggtacaaagaggagctggtaccatttcttctgaaaatattccaatcaacagaaaaagagggaatcctccctaactcattttatgaggccagcatcatcctgataccaaagcctagcagagatacaacaaaaaagaattttagaccaatatccctgctgaacatcgatgcaaaaatcctcaataaaatattagcaaaccgaatccagcagcacatcaaaaagcttatccaccactatcattttggcttcatccctgggatgcaaggctggttcaacatacacaaatcaataaatgtaatccatcatataaacaaaaccaaagacaaaaaccacatgattatctcaacagacacagaagaggcctttgacaatattcagcagcccttcatgctaaaaactctcaataaactaggtattaatgggacgtatctcaaaataagagctatttatggcaaacccacagccaatatcatactgaatgggcaaaaactggactcattccctttgaaaactggcacaagacagggatgccctctctcaccactcctattcaacatagtgttggaagttctggccagggcaatcaggcaggagaaggaaataaagggtattcaattagggaaagaagaagtcaaattttccctgtttgcggatgacatgattgtatatttagaaaaccctgtcgtctcagcccaaaatctccttaaactgataagcaacttaagcgaagtctcagggtacaaaaatcaatgtgcaaaaatcacaggcattcctatacaccaataatagacaaacagagccaaatcatgagtgaactcccattcacaattgcttcaaagataataaaatacctaggaatccaacttatatgggatgtgaaggacccttataagggtgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagccctcggaaataataccacacatctacaaccatctgatctttgacaaacctgacagaaacaagcaatggggaaaggattccctatttaataaatggtgctgggaaaactggctagccatatgtagaaagctgaaactggatcccttccttacactttatacaaaaattaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaggaacttctgcacagcaaaagaaactaccatcagagtgaacaggcaacctacaaaatgggagaaaattttcgcaacctactcatctgacaaagggctaatatccagaatctacaaagaaattaaatttacaagaaaaaaaaaaacccttcaaaaagtgggcaaaggatatgaacagactcttctcaaaagaagacatttatgcagccaccagacacatgaaaaaatgctcatcatcactggccatcagagaaatgcaaatcaaaaccacaatgagataccatctcacaccagttagaatgacaatcattaagaagtcaggaaacaacagatgctggagaggatgtggagaaataggaacacttttgcactgttggtgggactgtaaactagttcaaccattgtggaagactggtgactcctcaaggagctagaactagaaataccatttgacccagcaatcccattactgggtatacacccaaaggattataaatcatgctgctttaaagacacatgcacatgtatgtttattgcggcactattcacagtagcaaagacttggtaccaacccaaatgtccatcaatgatagactggattaagaaaatgtggcacatatactggattaagaaaatatggcactatacagccataaaaaggatgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgactttataatagcctagacttgttcagttgtggattctgttcatctgccaaacctttaatgagtgcctcagtgctggccactatgctggggacaatcctcctgactcccctgactccctgccaatcaaagactgctatggcttagaatgatgcatttgcatgtagttgccttactgggtaatgagatgaccaatgtcattattaactggctttgttagaaaaattcccccaactagtgtaaattagttcaaccattgtggaagactgtggcgattcctcaaggatctagaactagaaataccatttgacacagccatcccattactgggtatatacctaaaggattataaatcattctactataaagacacatacacatgtatatgtattgcagcactattcacaatagcaaagacttggaaccaacccaaatgtccatcaataatacactggataaagaaaacgtggcacatatacaccatggaatactatgcagccataaaaaaggatgagttcatgtcctttgtggggaatgaagctggaaaccgtcattctcagcaaactatcatgagaacagtaaaccaaacattgcatgttctcactcatagctgggaattgaacaatgagaacacacggacataggaaggggaacatcacacaccagggcatgtcggagggtggggggctaggggagggataatattagcagaaatacctaatgtaggtgatgagttgatgggtgcagcaaaccaccatggcacgtgtatacctatgtgacaaaaatgcacactctgcacatgtatcccagaacttaaagtataattaaaaaaaaaatcccccaactgataactgctatagttaacatctaataactactgagcacatatttggtgccagacacagagccaagccctttactgacattatgactttttcatttttacattatcttattaagtagctttgattgctgatgttttagcagtatgaatgctaaggttaagaaggttaagtactcagcctagggtctcagagccgctgggtggcaaaatggagattagatcccatcataccaaatccagggcccctcctatcatatttcttctgcctttcaggtttaagcaaattaagtggaaaactcccattaccctttatcgtagaatcagatggtctctctactgtacctctcagtatgctattgctattattcaaaatgtgttcattccctaaccatttctattttctagagatttcccaggtagctaatcaatttagaaaagtaactgcaacagcctagttttaaatttgattttcattcaaactttattaatttagccattagttttcatttaaaaggaaaggcattttaccaacatgcatatcatatataatcattacaactaatttcccaaattataatcaacgttcattgcaattactggtattttacataaatattataaaagcaatgttatgcatggttccatatcattaacaccatactaaatttacatataaaattggatataatgtgccctaggaaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcctgatatactctgtccagcctctgccccactctccattgcttcccatcccattccaagcctttgttctcttaaggagctcctgactgtcctttagacagtccatcagttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttgatccagaagaattaactctgcctcctttagtttgtgctttcttcacaactgcttaccctctttctgtagaggactagagtttgagattcacaggaagaagcaacctacatagaggccattggtgacaaacattctctatgagtttctggctggcaatgctgtagtcttgggtgatgagattaacactgggacaagaaatggtcccataggtggatgtgaagattgagacttgtctggaatttgcttagtgtttggaagagaccatctctagaagtaaagtactaaaaatactaccaatgagacagagatgagttgctattattagtgtctctgtcattattagaactttcatcattgttacaactcagaaaatgatattgggaattagagaaggtgaaaaacatacccaaagtcacacagtgaagaaggagtaaatctgggacatgaacttaggtctttctgactctgagaaccaggctagccctcagccagtaccaggctagcccacaggcagtaaagttggctgatggattggggtcattggtgacttgggaagtttctgtggctgtgttggaaggggactgggtggtcctacatgttcctagttgtatgaagttgcatgaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaagaaccaaaattgggtctaaataacatgtaacactgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaatatcagtatgtacttcatagagttttttttttttttttttttgagacaaagtactgctcttgtcccccaggctggagtgcaatggcacgatctcgggtcactgcagcctccacctcctgggttcaagcgattctcctgcctcagcctcctgagtagctgggattacaggcacctgccaccatgcccggcgaatttttgtatgtttagtagagacagggtttcatcacgttggccagactggtctcgaactcctgacagcaggtgatcagcctgcctcagcctcccaaagtgctgggattacaggtgtgagccaccatgcccagccttcatagagatcttactaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaacgtaacatcttttcaccttaaataacttgctgtttttgtaggatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactgacttcttggaatctagatttcagtacagtccagggcttaaaagatataacaatgatctcccttctccgtctatgacctcttcgtgatcacattcctttacataacaaaaatagttactgagtttgttaagctgggattgcctcagtttcttataattttacttgtgaagctgaaaaataaatgttgagattttatagttgagcaacaaaatttacagattcttagggtgggaagacattttggatactatttagcattgtatttacattgaacaaaggtaaaaatagggacttgtagtgacatactgaggtcacctagttagttcatggtaaagttggcaatggaatcaagatattcctataccatctcttagaaatcgaggatactagagtagaaaaaacccctaggattcctttggtgtgactcctgcattttatagaggaacaacttgaggctaagaaaagtaaactactcgaggttacataccttggtggtggcagtctatccacaaactctgaacttagtccaaagttcttaacccaattatatcgagaacacagtgaatatagcaagtaaccctagagttcgttcttcatagtatttgaacaaacacacttgattatcatgccccaggtttgtagaatgaaatcaatctggtttatttctttttcctttcccacacccctactcccattgaattcaagcacgaggaatagaatcaccttcatgtatttgaatatacaattcatgacatcgttactatggtaagacaagttcatatgtgtgaatagtagcttctgtcaataagccctctgtaaatcaccctgaaaattgttagaaatactgtcctaggacaagaaggatactcagtgggtgaagtcttttttaaattttattttaatctttatgtctacagaactcatctgactcaagtgacttgcatacagcggctgcttaaaaaatgtttattgacagattattctgacttgagctcatttgttcattcattcattcattcattcattcattcaacaactgtttattatatgcctagtgtagacaacataagtgcattcctacaacatgagcaggaatagcccaggaaactatgatttttatgggctttaaaaatgtttagtgaactaaaagcttacacactaaagcttctgttgtatgtggagtttaagaagtttttgtgtaaccatataggcaatagcaccaacaaaccgtttcctctctgcttgccttacagtaggcatactttatcccctgccaacaagaggcttttgttcaatccagttttttctgacatccagctcaccaaacaagttgggtttgataaactgtttcacaaagcaatagagaaagctaacagcctgacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataattttaatgtggagctctatccaagttttagtatgtaataacttgatttgaaatgattgaaaaataacttaaagattttcatctgcattggtgctttgatattaatgcctattaagatgttggtaggcactcagatagtaaatataatttttctttaaaaaatccatgggttttaaacaatttagaaaaacatgaggtagttaattaattccccaaattaatctctcattaatgcagacagtgaactcattataatcctggcatcaggtactattaccaatacctgtctgtggtttgttagaagggccctcccctctgcactgtagtaatgagatggggtgggagagttgtcatccaaagtatatccaaattcacttaataacagtcttcctgtgttttcttagaattctaatttaattcttttaaaagtccaccgaaaacaaaaatttgttttgacatgttaggcacaaaattgttttaaatccactaaactagctaaaaccaaatggattaaaaccccaaaggaaatctgacttttgtatgaaacaactaatacttaagtgctgtacacttttcaaagagccttttacagatattattccactgtacagtgatagccagccaccatgtgaggtgggtgtcattcattcattcatgcaaaaagcatttatcaagtgctattacttgtcagccactgtcccatgacctgtggatacaacagtaaacaaagtggagaaatcctctgttcccctggagctgacattctagtggagagaaagaaacaacaatggtacaagtgaaatatatattattggattgtctcgagtgccgaaaagagacataaagcaggggaaggggatggggaatgtttaaggtgttgcaatttaagatagagtggtcagggcaagtctcactgagaaggtggcattggcgtaaatgcaaaggtgatgagatattgagatagatatttgggagaagataatttcaggcagagggaacagcaggttcaaaggcccaggagcagcatcatggctggtgtgctggtgggatggcaagggggccactgtggctgggtggggtaagttgggtgggagaatggtagaggataaggcagagaagggacaagagacagtagccaccatttgtaggccactctgtaggttgtggcttatgttctatggaatggtatggtttcgaacaggcagtaacatgatttgcttgcattttaacgggatcactctgactcattttaagagtagaccatggttaggggaggggtcatcagaatcagagaagtcagtttggagactactgtgtttattttggcaggagataacggtggctcctttaagtggaaagtagtaaaaaaaaaaaaagtgttggcaaggtcaatggcaaagtcaactctggccataataacagagagaaacagttgtcccctatattgagtagatgtcaaagttgaaaggaagtactagatggttccctcttgtcttgagataaaaccttcttcctgaactcccgattcatggactccactatcccatcgcatcactatctttttcctccaattctgaatcctatttatctcttttcttttctatcctaaagctattaacatctccttctttaccagtcttccctgtgtataaacaatgtccagtcttttctacattaaaagataaagtcttccactggtatctacccagcactatgatcagtttcctcatcacttcactcttccagcaaagctttttgtaagtgctgtctctattggttgtcgctgttttcttctcatcgtccttttcaccctctgcaatttggcttctgcttgtgcgctccactccctagtagttcatccagggcacttgggctgtcctgatcatgcccaacaatgactcccatgttgccacatcccaaagagaccttctgatccttaccttactggacttcatcatttcatttctgaactatctatctctcttgtgtttatttccataaactgttcattctctgtctcctttgttgatcccttttccttatggttcttgacatgtgttctggagtttcatgctggcctcatggagcttgcaaccttttataattcccccagtaacctcatctacatcatggatttaaccactacttcttgattaataattctcaaatctctatctctttctctgacttgtcctctgagcctcacatttgtgccaacttcttgttgagtctaaatccccacaggcacctcagatgtaatttgtccaaaactgagatcattatcgccctattcctcctgtaaagagtcacctggtgtccatgatggaatcctggaaggtatcacaaactcctctcttcatctctttatgccacaaaaagttagttcatcactaaattcttccatttttgtcatctaaatatgtctgtaatctgtccccacttctcattttctcctatgcatatacttatttaaagaccttattgttttgcctcctacagcagtaatcttctaattagtctccctgcctgcagtattgctgacctcaagttaatcttccactgacctatcagtgaaatgtatcccaaacacaaatcaaatctgactgtaaaagatcccacttaaacttatcagtggctttgcatcacctcaaggataaagtcccatttcttcatatggcatccttgactctctaggacatttcaccctccattgtacactctctaccctagccacacccaaatcctggcaatttcctgcaaatgcccatcttcagttctatgctctgaccctttgtttacaccccatttgcctaaaatgtcatgtccctactgccttttaaagcgggaagacatcatactcagaagtgaacttctcctgagaggtataatgggagagcgaaagactatacactttggaaatggatcaaactctctgcaccttagtttccacgtgtgtatctttaaaaaaatgaggattataggtagggttgttggatggtgaggcatgccagggacaggcacatattagatgctttctgaatggcaacaacttcagctcaggttcaactcatctggagagtctctttttatgtcctctctgtcctgcagctaatttaatcatgccagcactgtgctctcagaatattattttttaactcccataatcacagttatacttgagtttgacattgtccatctgctacactaggtataacattcttttgggcagagattacatcctattcctcttaattccccctacgtgatcagcacctcatgcatggctaggcacaccataggctgtgggacaaatataagttgggcatctgttaggtaattgaaagaaaaactataaggtccaatggcaagaatatcttttcactcatctctaacatgcatgtattatcattacgctatccttgtgttttctttccaattaaaataatatctaggatggttttaattttctcagatgagggagcacagtaaagaattactgaaagaaagaggaacagcagaaaatatacaaggggaggctgcagaaaatctaggttataacccagatctgccactgagtcaatatgtggccctgagcaaaccatttaccttctccaatccccagatttcatatctataaattgaggataattacatttttcctaattttcagagttgggagaatcaagtgagacctacaatgcatgtgaatgagctttgtggcatttttgagcaccctcataatagtcagaaaacattgtgcatttgagagccacagtactgggcacacagtaatagttgtattaaactaaagagcagcctcttggatatttgataatttctaagtcgctggcttttatggtacattaaaaattatatacacttgcatgctgtgcattaattcttttacataacgattaaaaatgtagcatcatgctatgaaaaattaaactcaacactgcaagcataattgtaactctgatagtatgttaacaagtccacatttgtacttacctccctgtggaaagaactgcgagtaaatctctttgaaggtttcttcattaacaacaccactggggcattcctagggaaagtggcagagaagcaatatgagcaaagtgttcataaaactgaattttttttgcacattttgaaacagaactgtctaccatgcaaagctgcaccaagaaaattaaccattcatccattattacaaagggaataaaagcacactataaacttatgtttgttccagttctcacaagaaaaaaaaacgtagatgtaaatatctttgcatattgagtatcaaagtaggtgtaatgtattcagaaacacagtgctgcttttaagaacacatatgtttattataaagtaaaaggaaattgcattatttttcacacagcaagcatgttgcaagatgtttataatatagtctttggtgaatcttggttttgtcctttcaaggttttctgaactcacataatcttcgattcaatggcagaattactctattggcatctctagtggctcaagaagcttcaaccagtaatagatactaatgcttgttaacaggatgtctaggcatacccaagacatggttttgtaacaagtgaccttgggtgagatagaaccccatatttttgaacttccggaaaggagagtctgcaaagaaatggcctggcctgggcttaatagatccccacctttgtccctgggtcaacttgtcaaagaatgatggacattgatcttgggaactacacccatgttggacaactgacctggaggggccacagggcaaggttagccctctgagagtggttttggcatttttgctaataaaaaaaagaaaaaaagaaactttaaagtgtcagaagggggctgccttggtgcagaatataaggtttgagcaagcaaattgtcccccaatctctggaaattcctccattttttggagttataagaaccagtgtggttaagaatttaggcgtagaggccccttgagtggtggagactgacaatcacatgatagcccagaattgaatcatgtgagatattaactgtatggtgatcccttgttatccttggggcattgcttccaggaccaccgcggataccaaaatccatgcacattcaagtcccacacttggcactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgtaagtggagaagtggtaagttctgtttagtctcttttagtagattctcatgaacagtcccatgtgatcagagctcccctgactctagttgtcacagcactcccacgccacctaacgtccacccaggactaagttcactggggaaggatgaatggtgtgctaactccccaacagacctgactttagacatgaatattctgtgtactctaaatttgatactgtttccagcatctttatcaatcacctatggtagtatttaaaacatcacttaacccttaaaatcattgttccctcactaataaacttactttctttattccagtgagtcagttactcaactgtaatgtgcttcacctgcagaattttctattttctcatttgttgttttgaaaggtaggacctttgatacataaacagtgttaacagtttcaatgtgaatttgtgtttacagagcttctcgatatggttttatcccatttgttaatgatgagcttaggtaggcaaaatagctgcattcacagaggcagaactggaggtgctgagtggcaaagcactttgttacacactaagccagtggggaagctggaatgtgggcttggaactctccaggtcatgacaaggtttcgtattagatgacccctgtggaaataatgatgacctcaaggacctaagagaattggagtaaagaaaaaaacaaccaaaaacaaatgagcaagcaagcaagcaagtgaactgtgatggttgattttatgtgtttaacttctctgggccatagtgtccaagtgtttggtcaagcattattctggatagttctgtaagggtgtttttgagatttattacattgatgcaaaattgcggcttttgctattactttcaatacatttaagctggtagactttaagtaaagcagattgccctccacaatgtgagggggcctcattgaatcagtttaaggcctgaacagaacaaagacggaccttcccagagaaagagtgttcttcagacatcatctgtaatattggcttcccttgttcaccagcaccctgcctttggacttgaactgtaactgttttctgaggctccagcttgccagaccccttcattagatatcaagctggccaaggctccacaaagtgtgaaccaatatcttaataagtctctttatactcacacatcctattagttccatttctctgaaggaccctaatacataaatgaattaacaaccaatagctacaactccaaaggtggtatgtatacagctaatctctcaaacattttgactatctatctagctgacaccaatggacccattttaagactaaacactttgcagttagaccctctcacacatggaaattgtgatttattggctatttaatgctaagccagttgcttgggatagtaaggagagagtaaatacctggctctctgccatcaggtggcaagcttgtgcaaagttagagctggaaagttgcctgggagttaaaagttgatgctgataaaggaagaggacttcaagcaaagggacctctgcatcaacaaatttgttagctgccttcagtctctagatatatttgatagatataatgtgaaatgaatttgtaaactgactatctgatatgcatgtgttttatgtttaatcacatatctgtgtcagaggaaaccttttctctgccaaatgaaaactactggccaagtttcagggtggaaagtctcaccagataaatttgtttttatccaccttatattcattacattagtttacatctctacaaacacatactgtatgcctattattccaggagtcttctaggaactgggactgctacaataaaccagtcaaaggtcttcccatcatggaacctctatccaactagaagaataaagactgtctttgttcaggctcctttaacaaaatgccatagactaggcagcttataaacaatagaaatttatttctcatagtactggaggctaggaagtctaagaccataggattagcagattcagtgcttgatgaggccacattcctggttcatagatggcatcttctagctgtgttcccacatagtggaaggggcgagctagctctgtggggtcttttataaaaggacacttatctaattcatgaagtctctgtccacctgatctaatcatctcccaaaggccccacctcctaatactatcacattgggggttaggatttcaacatatgagttctaaagggacacaaacattcagaccatagcaaagaccaataactaaatattaaaaaatcaaatccaagaatgatgatcttttatttattcccagagattttttattgaaactagtgcatttttttaaaccttcaggtgagaaaaagatgctagtgatttacaagatggtatacattctgtaactttttcttcacctcttctgtgcagtgatctctccataaaagtggtctctctacttctctatcaagaatgaatttggccaggctgcatgtgcagcaaagtgtaaaacataaacaatgtgctgtattagttaactcttgctgctgtaaaattaggccttcaaatgtcccttaatcaaaatgcttgggaacagaagtgtcttggattttagattttttgggatttggaatattcacattacactcagcagttgtgttagttcatttccacactgctataaagaactgcccaagtctgggtaatttataaaggaaagaggttaattgactcacaggtcagcatccctgggaaggcctcaggaaacttacaatcatggtggaaggcaaaggagaaggaaggcaccttcttcacaaggcagcaagaaaggagaagtgctgagtgaaaggcaggagccccttataaaaccatcataactcatgagaactcacccacttatcacgagaacagcatgggggaactgcctccatgattcaattactccacctgctctctcccttgacacctggggattatggggattacaattcaagatgagatttgggtagggcacaaagcataaccacatcaccagttgaacatacctaacctgaaaatctgaaatactccaatgagcatttactttgaatgccattttgtctctcaaaaagttttggattttacagtattttgcttttttggatgagggatagtcaacctgtataacacagttaaaaaccacgtagtatatttcttattcacataacaatcttgggtgagtgtacagatcagctgatggttcttctagggacagaggctaatgaagatttggtgactttaacatatggcgccaacagtctctgtgactgtgtcatccagaaggaggaaaagaacgctgaaaagagtacatggaaactttttatgggccaggtcttaaagtggtatacatcatttctattctcattttttttgttgttagagatcacttaatgtgtctaccccaaacaaaataagaagtctggtatggccagaaagaagacaagaatgcagatttgtaaagagtttggaatatctatccctgtggcatgtttgaaagatactccaagtgtctgtgttctgaaacagttctcccactgatgctttatttattgatttttattttgtatttttgtaaagatgggatctcactatgttgcccaggctggatttgaattccctgccacaagcaatcctgccttggcctgccaaagtgctgggattacaggtgtgagcccagcctcccactgatgttgtaacatgaagattatcaagtcatttagcagtataaattgtctccatttcccaggtgtcatttttaaagactgtttacttgcttcaagtaaacaagtacaatgaagcttaaatgtttgagcatgaattttttcattagatttttctaaggatccaagaagcagtagggttcctgggtttagggatagtaagaaatgcctcactcatccatcttctgagaatttgctgcaagcttctactaacccttatggttctgtattctattttctaatgaaattttgtctgattattagcaaatgattattccatgaaaatatgccctctatagaaaaaaattaaagaaaatgaaaatcacccataatctgactactgtaagagtatattggtcatttatataagcatatataccgtagaaataaagttttaataagacaaaattatagcattttatgttctttaactttaggaaatatcctgaacattttttacatcatgatttttagtgactgcataataatgcatccattgaacttaccatactgttgcatattgaggcgattttggcatttttgcactacataggaataatgatgtaattaatattctatgcatccttctgtgactgcacttgtggtttcttctttatgactaatcccagaaggagaatcgtaagaccaaccagtttaaaccattgaaagctctttctatgcacagtcatggtgctttccagaaacgctgcatccattcgtgctgccaccgcagctttatgagaaagtctcacaccgagaggagctaccgactagaatcacatgggaattggacacacacacacacacacacacacacaaccccatgaacaaacagcaataatttgcttccctcatgaatccaatcgtcattctgaaaattaccagtggacattgaggcgtttggacaggtccctccgaggcataaagcaatttgcctgtttttcacacagacagggtcgctgtgatggcactcagccggaccacatcaccacaatcacagcggtttattgaggataaaataaacaactccattccttcttatgcagaccattacttttaacactttcatcaaccctgaaaggtgggtattatttagacatgaggacaatgagcttggagagatgaagtcacttgtttgagtcacacaggttttgacagagacatctttttgctcatttattcaataagtagttatttaatgccttctaagtgtcagcaaatagttcatatgccttttactattctgggcactggagatacaggaatgagtttttaaaattccatttcttttttgctcttgtggaatataacatttagtggaatcagactcataactctgactccatgaattgcaatgctatcttgccttctggattattactttttcttctattaggactgaaaacatagtctcctggagagtcatctgtggaaatccttcttctgggaagatgtacacggtgtatttgtacccagaggcacccatcacagctgcgttggagagaggcatgtgcaaagggaagccatttcaatcaaaattgggatcaccgattaaaatttattgtgcattgtagcttgagagatttgaggaaagcaatctttttctttttagaaatctttggttttagtgtaacaagaacctccccaccttcctgtgtgccacatactctttactgtcattgtaaatggctagatagtaatgggctgaggaaaatgttctggtttttaggaccagtcaaatgaactgctccatccagtatttaggagctggaggtctctggttctgctggctggtatacttatctatgatgaccattgcatttctttcattgcctgtgaaacccttcactgtgatatgatcacaacacaataaaagtagaatgaggttttctttgcaatataactgccatagatttgtctgttggtgaagaaacagtcgccttttggggccttactgctgtgttccctgatgagccttttcagtcctctcaggccatgtggggacacatgtgagggtcaagattagttgtagatatgcaatgaatactatgctagtactaatatcaattttaataaggcagtattactattgtaataatcagcataaagtaatactttattggtattgatattttataattattaatgtgatgatgacaatgatgatactgatgatattaagctaatacacatgagcactttttatgttccaacccttgcattaaatgttttacatggattatctcgtgggaatagaaagatgttagtattaactccattttacaaatgaatgaactgtcttagagaggggccactgcattcccaaattagaaaatagcagatctaatctatagatcacagaatcaggaaacttgagagtttaaagcaactttagaggccaggcacggtgggtcatgcctgtaatcccagtactttgggaggccaaggtgggtggatcacctgaaatcagttcgagaccagcttggacaacatggtgaaaccctgtctgtactaaaaatacaaaaattagccaggcgtggtggcacatgcctataatctgaactacccagcaggctgaggcaggagactcacttgaatctgggagatggaggttgcagtgagccgagatcacgccactatactccagcctgggtgacagagcaaaactccatctcaaacaaacaaacaaacaaacaaacataaagcaactttagagacaattcaattcaatgtcctcattttgaaggtgaggggatagagattaaggaggttataggaactgaccatagatacacagggggctgctaagcctgacctcatgtctaggtttcctgaggtctaggactaagctttgatactgcaaatgtcttcgtgtccatacaatagctggtaatttttgtcaggtactatttagaggaatctagtgcagtgcttatattcttgggctctggagttaaatagaaggcctgggttgaacccctactctgccacttgggagctgtgtagcttcaggcaaactgtttaatctaagtctcattgctctcctctgtgaaacggggacaggaattgacctcagagagctgctataagaatgaataagatacacatattatgctattatcctagccctctaccttacacatcatatttggtcatttaatattagctgttagtaccatggtaatagtttaggatttggtaagcagaactccatcacgcaatgagtcactgtaacatcaatgccgatagaccaaggataaatcatatttatcaacgtggttgaatctagaataacacaggtctgaaatgcaatcagcttatgaagtatatatgaattacgctttctattctagtgttataagttgaatcactctatctaatatcatcagaatttaccctaaaagaaaggaatattgtaattgtaaatgatagcagaggagaataaaggccaccatcatggaaataaatgtcagtagaaacccaggagcctcttatttattaatttaaagttttccccagcgatgcttacatggtatgtttgaaatcatcatggaaagtgttgggaagggtgctttggagaaagatccatgtatgcataggaaattgctaagaaacatattttgtgagtgcttcaagagttcttatactttcaccttataaggaaacctttcagcatttcctggaaggttttcagagctctgttgaaatgcatgagaaatagctgcagtggtatgcaaatcacaggtataataacatcatataattataatattgtccactccaataatctttgcccactctattagctgaaatcttctcttcccctaaatcattctgttctgatatgtgtcttctcctcaggatcagaattgttattaaacatttagagacttcttcaggattaaaaaaaagaattacagtaagacatttcataggaaaaaaaaactaaaagtgcttgtgaaatagttatttggggatcctttcatgatacctgtaatgccacatctcttaggcatctgtatatttcaccaactctcacacccatctctggtgctaaggagaacatacaaggtagtctgctcggtctatcagttaaaatagtatttagcatgtagtatgacaattcagagattctctggcattctataattgcaggagaattttcaaaatttaaatgacacaatcctacaacctgtgctgctgatatcaccagattctgtggacttctctgctctctttagagttagtaaatacaaggcagggactaacctttacgatgtttagaatagggaatactaaaaatatttatgctgaatgaataaatcttcagtcagttcttagcttttaataaattagaaaatgaatttgctctgataatgtccttcaaaacttgggcctacatttttagaactcctaagaccaagaccaagatagtcatgggggttccgatatccccatgattgcccacaatgactatgatcgcagaaattaaggggagatggctaggatcaagaaaaacacttcttatttcaacataaaaagcttaacatagtcaaaaattggattctaaaaagctcatttaaaaattataggattaacctttcagttttcaaagcagaaaagctgatcattaagaactagagctggctataaatttctgttctaatatgcccaggtgtttgaactcctagcaactcatttattccttcttagtctaaatgttctcatctgatataacaggtaagtaatactaacatcacaggtaagcaaaagaaatgcaaactaaaatagacaatggatgaaagaaacccaaccaattttaaaaactgaatatactcaacatgttggatattttcttgtttccaaaatctgcattaactgcctcttccatttcctgaacacacttctggggtcaaagtggttaaataggcactgcagattaaaaaaagaaacagccaatggtgggaaaaggctgacctagatactatccttggaaaaggaatgagagctgggtgaccaagattcaattcagctgcaaggatgtgggcacattctgagccccacgagttctcagggtcacccaggatgaagcagaaatccaaggtactaggcaaaggttctctccccttcagttctgccctctaaccatatggaagaaggaaatcacatgagatttacagccaaaaaaaaaaaaaaaaactggctcaagtttcagctctactactaatgaagaaataattgaaaagttctgctttgagtcttagtctttaaaaatgcaggaaacaatagcatcttatagtaaagaaatgagaactaattggcattatgtatataaagattctagcataatactaaacattctacaaattgtacttatttttactattatctcttcaagtaacttaagttggttctgcaaaaagagattttccaaattttgtaggaaaaggcttcctgggattgggcccaattcctgaatctttagtggaatgcatgtagaattgtttgatttacggagacttttaaaaggattttcccaactttatccagaagacagtgtccattttgtcagggtcttttaaaaattatgatgtagtgaaattctataggcacccaaaaccatttagtggaaaaaaaagacaatggtgccctgggacaaagcctatgtatcagttttctattgctgcataaaaaatgaccataaacttagtaactctaaacaacacaaatgtatcatctcacacttctgtgggataaaagagtctgacatggcttagctgtgtgctctgctcagtctcccacttaaactggctatggttctcatctgggccttgcagtcctcttccaagctcactgaggttgttggtagaattcagcttctgtggttgtagggcccaggtccctgtaaccttttggctgtttactgggggcttctctctcagcttcattccatcttcaaaccagcaaagcaaaggcctgttgagtccttctcacactctgattctctctgacttcccctttggtaaaggactcgtgtgattagatcaagcccacaaagatcatctctgtatcttaaggtcaactgccctgagactttaattatatctgcaaaatctcatcacagtagtaccttgcttagtatttgattggataaccaagagacagggatcttgagtggctgcatttagatatctattaatacctcccacagcctgcttcttctgaacatcagttcattttggttttcatagcagtttttgtttaacaacagtcttttttttacaattatactcacaagtgtatccaccacaactcgcaactatatttcttggcacctgccatagtttaatgcgatttgaaaagactatattctgtcaaggctttagaatcagcagtgtaaagaccagctgtgaggccaaaattcaatattttttatgagtgctaagaatagtatcccatatgctgagtgttccccgtctagagtatgtctgcctatatccagagcagaaataaatttttttagattttactaattgattagatcactttcaagttggcatgatatcagcctaataatattgaccaaaaaaaaaaataccgagtaaagaattctacttaaaagaaacacgcagtgtttcaatcagaaagaataaaataaaatacagcaggtactccatatcgcagctgcagcatgcacagattcaactaactgtggcttgagaatacttgaaaaaataaaaattaaaaataaataaaaaataaggcaggtgcagtggctcgcgcctgtaatcccagaactttgggaggctgaagtgggcggatcacctgaggtcaggagttggagaccatcctggccaacatggtgaaaccccgtctgtactaaaaatacaaaaaattagccctgcatggtggtgcatgcctgtagtcctggctactccggaggctgagacagaagaattgcttgagcccgggaggcagaggttgcagtgagccgagatcatgccattgcactccagcctgggagacagagcgagactccatctcaataaataaataaataaacaaacaatatgaatgaaaaacaatataacaactatttacacagcatttccatgtattagttattataagtaatctagagatgatttaaagtacatgggaggatgtataggttatatgtaaatactacaccatttcatataacgagacttaagtatccccagattttggtatccatgggggagggttctgaacccagtccctcaagaatacagagagatgactgcatggagatgatggtatacacatatgttcatatatatatacatggttgtataaagcctttttattccctgaagatttaaaaaaatctattctctcccagtctgatttctgtcacctactaaattggctagattctggccccttgataacttcatttagactatgatttctggactccttatgtgagattacacattttcctcatgtgtaagccattttttattgatcttttttgttacttatagtcaaaagcattctaacataagctacaaccttcttgtccttgtattacacctttctacagaaagagaaaataaaaatgagttgagtttacaggttgctgacaagtttggtgaaatgtctgctggagaaagaggtgtcgtctatagattacggtggtgggtgcgcatatgcaggtccagatttttggagaacgtcttttaaagtctatccaaagacactttgagaaagcataggaattgggggtgaataaaactcactttttttttttttgagacagaatctcgctctgccgcccaggctggagtgcagtgctgcgatctcggctcactgcaagctccacctcctgggttcaagtgattctcccgccttggccttcctagtagctgggactacaggcacccgccaccaagctcagctaatttttttgtatttttagtagagacggggtttcaccgtgttagccaggatggtctcgatctcctgacctcgtgatccagccagcttggcctcccaaagtgctgggattacaggtgtgagccactgtgcccagctgaataaaactaaatttaatgatcattcgtggtctgctgggcactgagccatgtggtgtaggagatacatgttctcattaaatccctgagaagtagaaaaggtagatgttttaccacacaatgtttaagaaatgagcacagggaggtttaaagaactttcccaaggtcagtgggactgggatttgaacttgagtttgactgcaaatctttcacatcttcctaagcttgaaaggtgagtgcacctgcggggggaaaagttaactaaggggtaacttttatcccaatgtctttcaatcctattaatcactaaaacacaaagtattcgttatttgttcaacacgtattcatataccaagcacttgactacgcacaggagcgtaacggttaatcaacaagcatggccctcatccaaaggagcttactacggaggaagcagtcagtattcaaatactgacatcaataaatatattgaaaccctcagggcaaagcagcatgaaaacttgaattgttttttacaaataaattgaaatgtcccaggtgaggggttggaggataggacctcaagttgtctggtcatctgctttggtgaggcaggttcaggacaggtcagattcagctctaaatacattttatacattttattatacattttgttccctttctctctctctttctttcttcttttttttttcttccgagtttcgctcttgtctcccaggctggaatacaatggcacaatctcggctcactgcaacctccatctcctaggttcaagcgattcttcagcctcagcctcctgaatagctgggattacaggcgcccgccacgacgcccggctaattttttgtatttttagtggagacgaggtttcaccatgctaatctcgaactcctgacctcaggtgatccgtccacttcagcctctcaaagtgctggcattacaggcgtcagccaccacacccggcccctttccctttcttattgccattctgagaaaatactagtttgtccctcttgcacaagtttttccctcagtgagctaccatttccaggagcagccctgagtctctgaagttaaagaaaaaaaaaaaaagtttagtctgcttaattaagttcttgttgcaaaactttcttagttattactctcagttgtagcttttggaatctaacagcccctcgcttatgagccactcatatcacttactagcctggaactttgaataagttactaaacttcttcaagctggattttatcatcactcatttatgcaggacgtatttttgaaattgttgcaattgttgcaaatacttgagaagtttccaccctcctttgccttctcctagtgcttcttcagaggctatgaagggaacaattatcaagggtcacggtagctgcctaaaaggaacctgtgtctagtacttcagtgcttccgagctctcaggtgggacagtaaagcctctgtctcctctccatgccaggcaaaatgacccaaaaggaaactcccgggcctgttgactctgagcaagctggggcagaacgcttccgagggctctctggagctcagacggcgctcagcgtgagttggaccaaacattcttagggttgtatcatcataatgaggcacaagggggcagtagtgtcctccatgatagctagaaaagcgatttccagttctttttcttaagggattgttcttttcctaagcttggtgcctgtctgggtaaatttctttcaagaaggctatttcctttttatgaacggtgacagcctcattcctacattagataatttaaaaaattaactatttctgggaatggggcccagagactctgatctccattttggatattacatttggtgtacgtcagtctgaattcacaatcacttttttggcagttgggccacctttaatttagtcaccaaaaacttgtagatcttagaaaacaaataagcaagacaacgccactaaagttccaaagcttgagtctgaaaaccttctgaaattgttaagtgtatgtgggctctggagtcaaagctgcttgagcctgctttgctgtttaacaggggaacattttaaacctttaagatgaaaataatgatactaccctatctggaggttattatgaggcttaaataaagataacccatgcacaatgtctagcgtcgtgcctggatgtataaacacccagtacacattccccatggaggaaattatttctacaatgatgctcgttctgaacctgttagcttttgtcatgttttcatgtaatatgggatattatgtttatccttgttaaataccatctgcttatttaatttcagaggattttcagaatatcacaccagtgttccacttccttagttattactctcagttttgtagcttttagaatctaacagccccttccttatgagccactcatatcacttactagcctggaactttgaataagttactaaacttcttcaagctggattttatcataattaattaatgcaggacatgtttttgaaagcatattatatgtcagagagtgtaagaagaaatggagctaaaacaatcaagacagatgaagtccctcctggagtttgatgactatcagagaagtcacacataaaacaaagttctgtgtaaataaccattcagttacagttgcgataagtgctacaaaccaagtatggaaggtctaatttatagggaagacttccctgaggatgtgacatttaaagagggacctgaaggataagtaaaaactagcaggagatattgctggggaagaggcaaaggaaccctgtgtacaaaaacctgtgatgtgatcaatgactaaagagatggcaaatgtgcctggggagtgtggtctgagacaaggttggttaatttggggcctgctagttacattaagaatcaaggtctttgccattcacaagataggtatcatatacctgtttttcagagctctggagagaattaagagatgatttacatcaagtgcccagcacaatcccaatcgcattctaaacactcagcatccctctcttttctgtttactctaccagagttgaatttttacctctggtttattatttattcaatacgtaattatttagcgtctactgtgtatcaggctctctgttataaactgaacaaacaaaaggggaaaagcagacatggtcttgcctttatagaatctctccactgatgagctattatgttctttgtgcatatgaatttatttcaagggaacaatagtttcaacatatatggcgattaaaatcttgtgctcctatctccaaaaattaaaagtaaataaaagcaagcaagcaagcacacagaataaactcacattgccatggattgcaatgtaaataactcaagattatgaacttgtatgtaggagttacttctgcatgtttctttgcttttgctaatgattaataataacgagtccaggccagacacagtggttcatgcctgtaatcccagcactttggaaaaacaaggcaggaggattgcttgaggccaggagtccaaggccatcctgggcaatatagtgagactcagtttcttaaaaaaaaaaaaaaaaaaaaaagttagccaggagtggtggcatacaccttttgtcctagctactcaggaggctgaggtgggaggattgcttgagcccaagagtttgaggctgcagtgagctatgattgctgctgcactctagcctgggcaacagagagagactgtcttcaaaataaataattaaaaagaataatgatgattgtttttacagtatattcttgcacatggtacagatggttagaataaatctctgtactactgaaagtgctaataagtctccattatattatcttaggggctaagtatccttcaggagggcagaaagactcccagctattaggtgtatctaaaccccacatggctatgtttaccctgaaactgaggcagtctaactcttattcctttctgtttacctgttttaatatattgcatatttatctatttaatatatacaaatgttgtcttctgataaaggtccagaaattccaggcatataaaagagcttcaaatcccaacaattctaccacattcacttttcatttccatctgcacatttttcatttttagagctcatggatagtctagacatttatttgcaaatattatgaaggtattatttcaatcagcaagggattctcttcaaaacttatatgagcttatggtaacaattcttattctctctagtgaggcataaagctaaaagttttatgtttttgccccgtaaggaaggaaaaacaatgcatgtttttgtttttttctagtatctcacagatattttcatttcctggtttaccagttgttaaccttaatgcatcccagaaggagattaatatttggatttaaataataggagctctactttcggtttcttgttatctttgctgggagatgagaagtctggggtggtttattctctgtacaacctctcaaaattgtactatagaccaacatactgaggaagataaggagcaatccctccagtacttacaatgctcatatgaaaatagatgattttctgaaagaattagaatgctatattttattaattgtttctagttagactttaattccaacaactaatatctccttctttaagaatgatttccctaattctaccgttaggaaattatttaattctaccataattatgttttatttttttccattttatgccactgtgccaggcactgtccattttatgacatatttgtgtcagcttaacaaatctagctcatcagttcagaatcaacaatgaaccaaatattactgtagattatatgttaatacataggagcacagttattacatgtataactatttctccattttgtgaccattatagggtaattatgaatagatgaaggcatgattactttagatcaaaacacaggcaaaaaaaatggatcttctttggggaaatgttttatgctatagactgaaagtgtgtgtggcctccaaattcatatgttgaaacctaatctccattatgatcatattgggaggcggggtctttgggaggtgtgttagttcattctcaggctgctataaagaactgttcaagaatgggtaatttataaagaaaagaggtttaattgactcatagttccacagggctatagacgcctcagaaaacttagggcagaaagggaagaaaacatgtccttcttcacatggcagcagaaaggagaagtgccaggtgaagggggaaagccccttataaaaccatcagctcttgtgagaactcactcactatcatgagaatagcatgggggcaactgcccccatgattcaattacctcccactggatccttcccagaacacatggggattatgggaactacaattcaagatgagatttgggaagggacagaaagcctaactgtatcaggaggtgattaggtcataagacttaagtttttaatgaataggattaatgttcttataaaagaggcccaaagagctgctgtgcctcctccgccaagccctagtgacataatggaaatatggtcttccatgaaccaggaagagggactttaccagtaaccaaatctgtcagcacctcgatcctggacttcccatcctccagaaatgtaagaaataaatttctgttgtctataagccacccagtttatggtaatttgtgacagtggaggttgtagattacagagaaaaagtggaggttgtagattgcagagatgaattagtgtagtttatgaaaccatgaagtttgacgttcctgagggatatcccagagaagttgggaaaccagtaattagaaaggagtttggaactcaggtcagaggtcaaagcttacagctatcagtttgtgctcctttagcacataggtatagagatctcccaaggaaaatacctaatgaagaaaaccagggagctgaatgcacagccttggtgggaagctacatttaaaaaacaggaatgggataagcagtccatgaagaccaggataaagtagacagagaggtacaaggagaagccgtagattatatcaaaggaaccaaggaagaagaggcattcaagtaactcaaggcctccactcccaaactcagcagagacttcagttaggtccagagaagtcacaggagaaagtgttagtagcatagactctgaaacaggctgtgtaggcttgcatctagtctccactactcacactagctgtgtttcttaaattctttgtgccagtttattaatttacttgtgcctcacttgccttatctgtaaaatgggactaatagtatacttaccccatagagttaatacaaccataacattgaccaatatttgtagaaccttaaattcttaactcatagttagaattaaatatatttattgaatttaaatcaagcaattcatagatgtcaagattggaaactattcagtggatttgcaaatgaaatgtagttttgacacacacacaaatcagtacaaggaaaactggggaaatctgaataagatcagtggattacatcaatgtgagtaacctgatttaatattgtactgcagctttacaagatgatactactgggggaaatggtacctggtgacctccttggactatttcttactattgcatggcaacctattgttatctcaaaataacaagtttaatttaaaaatattggtagccatggaaaataaaggtggtcttgacctatgaaagaacaatttaaatgacatggtagaggcagaagccaagagttaagaaataaatgcagatgaggggttatatagactgaacttagacagctgttttaggaattttatgtaagagtataagaatgagacttgccaatagttagagagagctgtgtgtgcatgtaaaagttgttgttattgctgatttggaatgagtatgtcttctaatgcattttttaagggtgaatgagacttgactagcattacaatatgtaaggaggcagctaggaaaagaggaagagacagggaggaggaggaagggagggaggcagataaattataaagaggaatcaagatatcataggaagtgggattgaaaacactagggaaatggaacattcttttcttttatacaggaagaataagtcagcaaataaataccaaacaggtgccagctatacactggacttccttctaggagttaattaagcactgtggttttgattgaataatacagatcaaattcctctgtcccgtgagaaaatgagacagttctgtaggtacatttactgctggaatcagaagagctgtaaggatgtataggcatgttactgtaaatagatgaggagacactagatcatgaaaaagagacaagattatcaagctgagtgtaaaaattgctaattagtagtgactctcatatctggatttttgtttggttttccccagcaagtaatagagaagtggaagacaaatcattctctgaccctagagttcggtgaccccagagccatataggtatgtgacaggttggaaactggcttctcaaaatatattgataacctaatctctggaacctaccttacaagtcccccctgccccacaaccccccccccccacacaaaaaagaaatgaaaacaaaaaaaatttcaggtataattagtttaaggatctctataaggagagattatcctggattatccaagtgggccttttaggctatcccaattgtccttacaggagagaggcagagagatgtgacatacatacagaggaggaagggatatgatgatggaccagagagacatttgaagatgttgaccttgaaaattacagtggtgcagccacaagccaaggaatggtgacagctgccagaagaggaaggaaaagattctcccccagaatttctcaagggagcatggccctgctaacaccttgattttggctcagtgatattaatttcagactttcgacctctagacagtaagagagtaaatttttgttgttttaagcctttcagtttgtagtatgttgctacagctgcattaggaaactaatacatgcatgattgtaggacatggataaggaagtagggatgttcaagggtatttcaggaaatcaaccatatagtgcagattagtatggaacttgtgagactaagaagggctggtgatcccaaaggtcttgcttgcagaatcaatgagcagaatgtagtgagattgagggcttaagacagttgaatggatataaggttgtggtcaaaagggtgagaccatcatttaggatgtcaggaattaagtagtttcaggtaataataaagtccaagtgatatccatcagagtgaaaagtggaatggaaaagaaaataatggcatttaaagagtcaaaaaacactgaagctcaggtgagtggctggtaggcaggtcaactccatggatattactgtcaagccaatgaacaaagattttaaagtcagcgatcaaagtctggaatgagtatgatacagaaactctcccagtaataacatgagacgccctgattctggttctctgtgactcagctctgttagacaattttcttacttcaggaactgccaataccccatttaacatgatgctggtgaggcttttaatcccatttccatgggccacagggctaggtcaaatgatgcaggcttttccaggaacagttctccatcccccaggccaaaatgattggttcagtgtcatgtgactaaaactagttcctgccttgctggagttattagcacggagaaaaggtgagtaaaagagacagcatcctgatacactgttggagccttgatccagccatgcctgatgctgtaagtattcctatcttagatatgtgagtcaataaacctttaacttaagatactttgaatgggtttttgttacatgtactcaaaaatatcctaatttataccagaatagtattattttcttgctctttgttctttacagggtggctacaaaggaatcaatgtagcctcgtagtttctctggatggtatttcagtgctttgggagataaccaccacataaatgagagagttcctatttttctttgttattgttttactatctaaccccagctacaagaaaggatatattggtttattttacaaactttatcttcacaatcagaaggatgtgagctgtagagcattattttaaagaccagtcggaagatgaaatggtgcaaaaaataaaaaaagaagaaaaccaaattaatctgcaaacacattagaattttcaagatttaatttcactgttatttttgcccatttgaagcaaatctattcactagatctctattaaatccctactgtaagccaggtacaaataaatgagatgaacaatttgaactgatttcaagttgcaaagtaacaattatatgatgaatttctttgagaagcaaatgttggtatatcagtccattttcccgctgctgataaagacatacccaagactgggaagaaaaagaggtttaattggacgtacagttccacatggctggggaggcctcagaatcatggcaggaggcagaaggcacttcttacatggtggcagcaagagaaaatgaggaagatgaaagaatgaaacctgataaaaccatcagatctcatgagacttattcgctaccacaagaacagtatggggaaaaccaccccatgattcaaattatctcccattgggtccctcctacaacatgtgcaaattatgggagtataattcaagatgagatttgggtggggacacagagccaaaccatatcattcaatccctggcccctccaaatctcatgtcctcacatttcaaaaccaatcatgccttcctaacagtcccccaaagttttaattcatttcagaattaatccgaaagtccacagtccaaagtctcatctgaggaaaggcaagtcccttctgcctatgagcctgtaaaatcacaagcaagctagttacttcctagatacaatgggagtacaggtattaggtaaatatagccattccaaatgggagaaattggccaaaacaaaggggtcacagggcccttgcaagtccaaaatccagcagggcagtcaaattttaaagctccaaaatgatgtccttttattccaggtgtcacatccaggtcatgctgatgcaagaggtgggtttccatggtcttgggaagctctgcccctgtggctttgcagggtacagcctctctccaggctgctttcacaggctggcactgagtgtctgcagcctttccaggtacatggtgccagctgtaggtggatctacctacagctggggtctggaggatggtggccctcttctcacagctccactaagtggtgtcccagtagggactctgtgtaggggctccaaccccacatatcccttctgcactgccctagtagatgttctccatgagagccctgcctctgcagcaaacttctgcctggacatccaggcatttccatacatcttctgaaatctagacagaggttcccaaacccaaattcttgtcttctgtgcaggctcaacaccacatggaagctgccagggcttagggcttgcaccctctgaagccttggcccaagctctacattggccctttcagccacagctggagcagctgggatgcagggcaccaagtccctagactacacacagcatggggaccctgggctcttcccaacgaaaccatttttttcctcctatacctctgagtctgtgatgggagaggctgctgcaaaggtctctgacacaccctggagacactttccccattgtcttgggaattaacattcagctcctcattacttatgcaaatatatgcagctgacttgaatttctgctcagaaaatgggattttctttcctacagcattgtcaggctgcaaattttccaaacttttatgctctgcttcccttttaaaatggaatgcttttaacagcacccaagtcacctcttgaatgcattgcttcttagaaatttcttctgccagataccctaaatcatctctctcaagctcaaagttccacaaatctctgcagcagaagcaaaatgccacaagtctctttgttaaaacataacaagagtcacctttgctctagttcccaacaagttcctcatctccttctgagaacacctcagactggaccttattgtccatatcactattagcattttgggcaaagccattcaacaagtctctagggatctccaaacttttccacattttcctgtcatcttctgagccctccaagctgttccaacctctgcctgttacccagttcctacgtcacttccacattttcaggtatcttttcagcaacatcccacttctggtaccaatttactgtattagtcagttttcacactactgataaagacatacctgagactgggaagaaaaagaggtttagttggacttaacagttccacatggctggggaggcctcagaatcatggtgggaggtgaaagtcacttcttacatggcagcagcaagagaaaatgaggaagatgcaaaagtagaaacccctgataaaactgtcagatcttgtgagacttattcactaccatgagaactatatggggaaccacacccattatttaaattagctcccactgggtcgctcccacaacacatggaaattatcggagtacaattcaagatgagatttgggtggagacacagagccatagaatatcagttggtaacacactgaactagggctctaccattaagtaagcacacagaaatacaaagttcaaataaggataaacagggaatataaaaactattctgcttaataggaattcagatacctcttaattttttatattatctagtaattaagagtgagtgatattattgggaaaccataaaggatccatttcatcagcactgttttttgtttggttggttggttgttttgagcccttacatatatctggcactgggtaggctctgagaatacaatggaaaaatggcaggcctggttcctgcccctaccctttggttcctgtcagggtattctctgaggcatcacagggtttatccagttcactatttagtaaatgataaaactcacattcaaacactagtgtcctaaaacaatataagtctgtctctcctaaatgagctcattatttttgttttagccacctgagagtagagtttctaattcctatctagcttgctgttcaaataactgataattaatcccagaacattagtttgcttgaattgaaaaggcacatcacgttcaagtgcctcgtttttaatataaggcaaactgaggcaaagaatgttaaatgttcttcacagaacaagaggagaggccacttttcaccctcagcctagtgtttatctgactaaaccacaccgtgaaagataacagtctatgaagacaaaaattacaaggtttagaatcctctttccttctccctcagacaactgggaaataatattctttaataaagttgtggttattggactagcacagtagccaaatttaggatgacttatttattcttaaaggttgggactttcattctggaagtacttttaactgttaaagattcctctttccctttccttcttctttccttgcctccctcatttttcctacattccctccttttttttcttgtattatttcattacacaaatgatcatttattccatacaaagttatggaatgtgtagggtgggtatgctggatgcaagggatataaaattggcacagcatctttcttgctgtcagttggctcacaatcgagtggaaagcaaagatgcattcagtgaatcattacaaaacactgtgatgtgtgcattacggttcatcacagaaggagttttggacccttactgggaagaggagaattaagagctgggtgactgcgaaagatttgcaggggagaaaatggctggagagattttgaaataagggaagggcattcccccattccagcatgcagaactaccacttgcaaaggcaaatacgattttctgcagatcctcccctaaccccaccccagaaactggggatatatatcattgggaagagatacagtttaatagagaggaaacactgttggaccactctcccaacacctgtttctcaaatgtgaggcagggctagccaagcatcccacatcaagagaagattaggatgggggaagaggtagaagtcaggcaggaagaatgtgaaagacaagtaccagtctatgaggctggactggtaggtaggaccaatacttaattttctaaatgcatgccactttccctacagatcaatgactgctagcacttccctacttgcttttctttggatttttttttctttttttttttttttgctactgcatgcttctttgactactgctgccaaccttgggaatggattgatgacccacttgcttctcaaacagctctgcagataccacttaggaagctggtgttcgtgttctcagactgaggaggagcagtgtccaaaatcaattacctgggatggtgtgtgctgatccacctagcaatgaactcagatctttggagcttgtttataacacgtacattgctcaacataccctggttctaagatcagtgatgctatttcagagcacaatggggataatacattttacatttatttaatgtgaattttggaaaaatttgattaaaaatgccacctttggcttttttaaataaagaaaatcacaataaaggatagaaagtaattaatgatttttaaaactggttaaccatatacaaaaatcaactcaagatgtattaaagactgacattgtaagtccccaatctataaaactcctaagaccttggtggaaggatctccatttcttggtgggaatgtaacttggtgcagccactgtggagagcaacatggagatttctcaaaggactaaaaatagaattacaatttgacccaggaataccattactgggtatatacccagaggaaaataaattgttctactaaaaagacacatgcactcatacgtttatcacagcactattcacaatagcaaagacgtggaatcaacctaggtacccatcaatggtgaattgggtaaagaaaatgtacatatacagcatgcaatattcacagccataaaaaggaatggaatcatatcctttgcagcaacgtggatgcagctggaggacattaccctacgtaaactcacacaggaacagaaaaccaaatactgcatgtactcacttatacatgagagttaaggcttgggaacacatggacataaagatgagaacaagagacactaggaactccaaaagaaggagggagaaaagaggacaaggactgaaagactttctattgggtactatgctcagtgtctaggtgttgggatcaatagaagcctaaacctcagcaacacgcaattatacccttgcaacaaacctgcacatgtaccccctgaatctaaaataaaaataaaagccaaagaggcaagttattttagtgattttaaattttctttattatagtcttctatatttttccatatttctataatgagcatagtgttgtagttagcaatagatggaaactttatcagaaaaagaagaaaatcatcacaaccatcaacaaacttacctgggtaatttctgtcctgttctcttacgaaagttgcaaaaataaaaaagacaatttcttgctcatttagaatgtacactgtgctttataatacatatggccactaccaatttcttgcaagtgttttttttagactctgggaatatagtggatgggttgagagaaaaggtaccatttgttaaagagaaaacagtattagactagaaattggggtaggatacagttctttatctttatcaatgatatagccttgaacaactcccttaacatcatagcatgtgttttgttaacgtaagacgggcccgataaagtatctcccatctgccagacaggatgactggaaagaagtataaatattttgtaagctgtaaggtgctctatctatgtaagttgtttttgaggcgattattcttagtaataaataaaatactgcttagaaactcaacgtggacagtcttggtctagggacctacttattgtgcaattggcaaaggggcccttctgagatgatgcataggcagacagtttagatacaaataactagaaatggtcaaactgtaatatctgtcctttcccaccttttacatctcaaaaagcagttttcatgtttcatagtaataagggcttttacatctataaattccctttcaaacgcctacatctctcaacaaatttgctaccaccgcaatttattttttaggtggttttattcagatgaaaatagtttatttgagcactttggagttgctgtttgagaatgctatatgagtattaaatactgtattatatttctgatgctctttaaagattttcttttctgtctgcaatttaattttgtttttagaggttttttctcctcctcttctcatattgattttatttttggcgctattaaaaagtgctcaatgaacaacctttttggaatgaatgtaaataagtctgtatctctatgtatatgaatatttttaagtgcattaacttttagtataagacttatgtaatgattaatttgctcctcaaattctaattcttattcaatcaataaccattgttcacaattttaaatacattttattgatttttgaacatttaggtcattagtagtaagatcaatgttagccataattcacctttaaatttccaatgttcaggttattaaaaatcatttgcttttatttccagcataatttatttttaattgaaattcttccttgtgataatttttctttttaaagcaaccatgtcttctttataactgtctgagtgtccaattacattttcttacttatgaaggtttttaatatctaatcatatcttatgtaatcagtgggctattgtgtaaagtaatagttctttttctcccttatttatagggattttactacacacttccttcctccctatttttttctttcctgaacacctttcacctggtattgtgatagttcatttacttgtatgtattgctcactagatggtaaactctgcggggaaaggaatttttttgcatgtcatgttcgctacatcattcctgcatttagcatatgcctaacaaatagtagtctagcaagtattttaaatggattaattaaggaactctaaactacaagacaccaaggaacagatgttcagataaatacataaagatataatctacatgacaatgaaaaggttatgttaaaagtaaaaccctgaagtgcattagaataaatatttaaaaatactatccaggacatataacagttgctatttttctatttaatgaggtatattttggatcccagtcagcaaacaactctctctaccaaaagtagctgactatagcccagcctgtctttgcagttcatggcagaagaagagcagagaacacacagggctcaggtccagagttagctcagagaaaacagaaaatccaatctcagcacagtaaacatgtaggaattcagcatctcatagaggttactgaaagcaaagaatcaaaaataataaatggttataaatagtccatgctctcagagaactttgagtgcataaacaaaacctataaatcttcagcaaatgaaaataaggctctggttaataaaacaaaacaaaacagaaatggcctagtgtaattgttaagaagaggagaaaaacataccccaaagaattcagtatgtagttggtgaattcagagcaaacaaaaatggaaaattacaccttctcagccacacaaaagaaaagacttctaaggatttaaattaagagtatcacagtgaggaggaaggaggagttgattattgggcaaaatattttgcctctatcaaggcttgagctcatgagtaaaaggtgtgcgaggcctccttccatagtgtgcattcagtccttctcaaagaatccattcatttccacattaaattctcaagtaaagaaatcaatcaaacaaaaaaactcccacatgtgttattatagtttctacctggactatgtggacatgtcctgtctgtctatagcagttgcaatgctattgcccagagtggaaaaaaagaaaaagaaaaggagcttcccataaggtttatttctacatgttaaaaactctattgctaaaaccctaccacactagcttaggaatcacatttttagtaaatgtcaccaacattttaaaaatttggggccatttttatcctctaagaaatctcgaagagatccagaattcatgtatttaaaatttgtctcatataacaaataaaagaaaaataaagacaatgaacagcttcacagacaaaaaaagaaagatactccaggtaaagccaaaacaatacaactttctaaaaataatatagaaaaacagctttatgacttgaaaataacactagccattagttattagtattagattgcaaaaatagctacaaatgtctctccttcctgaatctatgcccttgggcagtccacttccatatctatgctgggcttggccctgtgcctgtctttgaccaatcacaaattgctgcaatcaaaggcctcgaaagcactaggtcattgaggtttgccctcttttgctgctctcaggacatcatcttaccactgccatatgaaaaagcacaggttagttttcctggctgccaacctgccaactattagatatttatgagacatcatcctagatcatccaggctccagctgatgtagctcagatattagctgagccatcaaaagcagaactgtaaatcatgagctgaatcaatgtttgttgtatttagttcctatatatgggaagggtttgttatacagcaaaagctaactttgtagaaattggtacctagaaacggggtgctattataactaaacttaaaacacagtcatgtatcacttaatgatggagatactttctgagaaataggtcattaggtgacttccattttgtgcaaatataagaaagtatacttacacaaacctagatggtacaccctagtacacatctaggctatatggtataaacttttgcttctagactgcaaacttgtactgcatgtaactgtaactgaacactataggtagttgtcacaaaatggtaagtatttgtgtatttatacgtatctaaacataggaaaagtacaataaaaatgtgatataaacaataaaaaatggtatccttgcacttaccatgaatgggaattgctctgggtgaatcaacaaatgaatagtgagtgaatgtgaaggcctaggacattgctgtacactactgtagaatttataagtaggctaccctaaatttatttaaaaaatatatatcttcaataacaaatttaactttaggttactgtgacttttcaaactttacaaacattttaatttttaaaagcatttaaactcttgtaataacacagcttaaaacacattgtacagttgtacaaaaatattttctttcctcaattttataagctttcttaatttttaattttttttttttactttttaaacttttttgttaaaaaccataacataaacaccctcattggcctaggcctacacagaatcaggatccctattatgactgtcttccacttccacatcttgtcccactggaagaccttctagggaaataacttattcaaaagaagttgacaaagccataagaaaactgatttagctggctggaaaaagggaaaaatggtcacctgcagtaagttggagaatagacaacatgtcaaatgaacctacagaccttgacaagttggtttgtaggcagaattttccaagtgccatttggattattttgttgcctaagataaaggaagaaaagagagagagagagattagccaaagaaagatggcttattttgcaagtagaattcagaaagaataaggagggacaagaacttgctaggttggaaaataaatctattgctcatccccaatcttctgtttctaaaatattctaaaataaagtatgttctggggccagatgaaaagacatgttacatatacaaggcaaactataaagatgacagtagttttttcatcataaataatgcaagttagaagacaatagaacaaaatctttccaaatactgaaagaataaaaatatcaaactaaaattccttatccagtaaagatatatttcaaaaacaaagacaaaatagacatttttagatgtcaacagctgaaagacataacttactacaagaaatgttgaaaaaagtcattcaagcagcagaaaactgatgtcagtagaagcctagttctacacaaagaatgaagagcaatgaaagtagtaatcacatgagtaaataaaatatttgtctttattatttaaatatccttaagagataaccaattatttaaagcaaaaataatgatgatttgagtttttatcatatataaacataaaatgtatgaaaccaatcatacaaaaaccaggaacaaagaaatggaagtacactcttgtaagatattttttttgcacatgaagaaatataatatcatttaatgacagactgtgaaaagttaaagatgtttgctataaaccctaaagcaaacgctaaaataaaacaatcaaactttataattaatgtgatgcttaagtttatatgttaagtttatatgttaacttggctgggacataatatctagatatttggtcatactctattctagctgttctctgaaggtattcttgaatgggattaacatctaaatctttgagtaaagtagactgccttccataatatgagagttcatccaatcaattgaaagccttaagaaacagattgacctctcctgagagagaagaaattctgccataaactgtctttggatgtgaaccacaacaattgccaccccaccagtctaccctgcccatattggacctactaacctcacagacatgtaaatcagttccttaaaataaacttctatatatacatctatacacgttattgattgtttctctggagaaggctgactaatactactaataaaaatcaagatagaggctgggtgcaatggctcacgcctataatcccagcactttgagaagctgaggcaggcggatcatctgaagtcaggagtttgagaccagcctggccaacatggtgaaactctgtctctactaaaaatacaaaaattagctgagtgtggtggagggcacctgtaatcccagctacttgggaggctgaggcaggagaattgcttgaacccgggggcagaggttgcagtgaaccgagattgcactccagcctgggcaacagaacgagactccatctcaaaaaaacaaaaacaaaacaaaacccaaagcaaacaacaacaacaaaaacaaatagcaatgcaacatatgtaaacccaaccatatcaataattatctcatatgccaatgggataaatgccacaaataaaaggcaatgattgtcagactgataaaaagcaagagctaattatatgctaccaacctactttaaatatagagataaaaatatgttaaaaggctgaaaacattaaaccactctgtgttagtcaaaagacagttgaagtggcaaacattagacaaaatagatttcaaagcaaaaatattgtccataatgaagatatttcttaataaattcaagagcacagaataatcttaaatatttatagatctaataatatagattaaacatatatgaagcaaaatatgataaaattacaaagagaaatagatgcatcaaaatagagtcagaaatttcaacttccttatcacaatgtttgatagaattttagaaataaattcagtggtttataggacacttgagcagtactatccaccaacttgaatgaaataacccaaatgttgttgaggatgtaaacaaactaaaactttcatgtacatctaatgaaaagaaaaactagtagaagtatctcatagaatagttggcaatatcttaaaaagttaaaaaatataccaaccctgtgatttagacattgaaaatatacacatttacccaggggaaaagatagtaagtatttatacaaaaacctgtacatgaatgttaacagcagcattatttgtaacatctttaaactagaatcgtcctaaatgtccatttacaggtgaatggataaacaaattgttgtatatacctataatggaatagtactcagcaacacaaagaaatgaacaacagtgatacataaaacaacatgaatgaatctcaaaggattaagactaagtgaaacattcatattcttattttataaaattttagaaactgcaaattagtcatgctgagacaatgtagatcaatggctgtctgtgaatgagattggcaaggaagggaactaaggaaagattagaaacacaagggaatatttaacagtgatggatgttttattattttgattgtattgatgatttcatgaatgggtatattcatatgtaaaaactttcaaggtgtatactttaaagatgtgtggtttactgcagcagtccccaacctttgtggcaccagggaccagttttgtggaagacactttttccacggatggggtgggatgcttttgggatgattcaaccacattacatttatggtgtacttgatttctcttattattacattgtaatatataatgaaataattacacaactcaccataatgtagaatcagtgggagccctgagcttgttttcctgcaactagatgatcccatctgagggtgatgggagatagtgacagatcatcaggtactagattctcataaggagcacacaacctagatccctcatgatatggtttggctgtgtccccacccaaatctcatcttgaactgtaactcccacaattcccatgtgttgtgggagggacccagtgggaggtaattgagtcatgggagtgaatctttctcatgttgttctcataatagtgaataagtctcatgagatctgatggttttaaaaagtagatttcccctgcacaaagtctctctctttgcctgttgtcatccatgtaagacgtaacttgctcctccttgccttctgccatgattgtgaggcctccccacccatgtggaagtgtgagcccattaaacctctttttcttcccagtctcgggtatatctttatcagcaatgtgaagatggactgatacacctcacatgagcagttcacagtagggttcatgctcctatgagaatctaatgctgctgctgatttgataggagtcggagctcaggcagtaatgtgagcaattggaagtggctataaatacagctgaagctttgcttgcttgctggccactcacctcctgctgggtggcctggttcccagcaagctgtagaccagtatcagtcagttgtggcccaggagttggggacccctggcttactgtatgttaattatacctcaataaacttaataaaattatgtactctataattccacttatataaaagtaaatacagccaatagtaaactatattgtttatggatgcaaactttggatattgaactgtaaatcaaagcaaagtagggataaccttgaaagttaggatactgaataactctaagatggatggaaagatttatcattgggaataacatctggattctagtgaagttctatttctcgatctctgtgtgggttatgcgatatttgcctaacaaaaaattgtttaagctgcacctgtattcatgttgcataggcatataagtgtggcttagggcattcagagcagtctttacatgatctaacaacacaacactgacctgcacattctctaagtgggacatctgagtttcatttctttgaaatgttctttaaaatttttgagaaaaaggtgttaacaattctgccacaaagattaagactggatttggttaatcttcaggaaagcagaaacttgtttgtaactacttgaaaatccctttctggtatttgagctttgtgggacttttgcagtaatttacagcttgattttaaccgggttgaactttaatttaaccagttgattgtggcaagttatgataaacagcatgaaaaagaaaaaacaatttctttcataactgataatgtacacatgctgaggagaaagtgggactctgaattcttttggtgatcagccattaaatcataaagaagaggtgtcttctttatgggaagatagaatagaagcaagatcttcttaggtatgtgatcctgggcagatgactttattatacttctgtgaaatggtgcctcagcaaccacttatattttggctgtgaaaatcaagtggctataaatgtattaaaatacatccgaagcctatagccctaaataatgtagcaactctcaagttgcttttattaatatcagttttcatagttttcattctaatttgtcatagttttcattctaatttgtttgctgatttcttatcattattctcagtaatgcagtctttctctgaatcatagttagtattcttgacccagtgactcaagtcagcatgtctaatttcttaaatctgaattgtctgcaagatttcatcttgattctatcttttgggttgcgctcaagccagtgtaccaatttcacaatatctgctaattggtacattgttgcctaccatctttaaaatagcctgctctataactctagtttttttaaggaaatcaaaacaatgccattattataaaagttaatgacatagcaataacagatctattgtcacagtgcttatccactgcaagtgtccaatatatcttactaatttttcagagtttagtatttccactgttgaagttctttttatttttcataagatggttcacaatggacacagggctcaacattacagaagaaattgtatcagtctttaacatcttatccataaataatggcattgtaaatacacacacacacgtcaattataattgatataccctcatgcaaaagcattattaaaatctacaatattgatataataataccacctacatcattgagttctgaaaattcaatgagtgcatacatgcagaaagtttaaaataaagactaggaaaatgtgtcggatgttttcttctttgatcttaaagacagagataaaatgtacatattttcttagtcgaaatctaacttagtatatatctattaagttaatatttactctgactctcaaacattctgaatctcttagtggccaatcacttgtctaatgccacccagttggaaggagctaaaattgcttttttgttttttatttgcttgtttgttttttgagacagggtctcactctgttgcccgggctggagtgcgctggtgtgatcacagaactggtttttaaccacgttttgggtaataatacttcacaagaatgctggatgattaaatgaagtagtgtgtgtaatgtgttggctcattggacagaacactgggtgctgagggatcatataggagtctgactctgcctaactcttcaccttgtttaataataacactctggaaagctcatttatctatacatgcctttaaaagcagacaaagcatttttattgcttttttttttttttttaccacttccatggcctaaaagaatcacttttgttttgaagactctaatttgcagagtaaacaaaaaagatggaaataactaagaaataaaacctccaaaagtttaggaccccaaataaaaatcatttgaaatgcataaaaatgcataaaataggtacaatgaatagtaatagatggaaaaaaacagattccatcataggtttgttacttgaatactaaactttttcaataattagctgttataatatccgtgttcaaaaacacagcactcagtgcagatcaaaattctaaaataaacaacagttactttccattttctcttgagtaagttatgagattacctctattgctctaatctagaagatatgaaaacaggccctccggccctaactgactctgtgttgtgtaataatatttcccttcaccaacctttacaatgaatataaaaattcaatttcagacctacaagctagaaagggctcaagtgtcaccagacttttctaaggggatattttctgtttttgtctacatttatatttgactcatttagtggagggaggtaataggatttttctatctgctatagaagctatttcagaagtacacagatataaggtcagaaaatatattttaaaatcacaaaagaaaacaaaatgatatgttggttttgaaccctagggtctttcaacattataatcaagcatgcctgagaatatctagctgtgacttcagagagaataatagtacacccttgagtctactgcaacagtcttccatggtatggtaggaaaagaatcctaggatagctcccaagacttacaagatacacacctcctggtgtgtatgccctgcataatctctgggaatgtgaatttaatggattttcctctgcgattaagtaaagctatgtacactatacagttgatcttaagacagagaatttatccaggtgggtgcgacttaatcacatgagacctttaaaagtagagcattttatctggctgactgaagaagaggaaaccagaaacggaaagcaggaaaagaatttgcatcactcttgttggtttaaaggtagaggggatagagagcaaggaaagtgtgcagtactccaggagctaagagcagtccctggctgtgggtcggcagggaattaggaaactcagtaatatagccacagtcaactgaaatttgccaggaagaatgatcttagacgtggattttcctccaaagtctgcagaaaagaactcagctttgcctatacctggattttggttttgcagtttctttggaagataacacagtgatggtgtgctggacttgacctacacaattgttagctagtaaatcagtgtttttagcctctaagttggtgataatttgctacgcagcaatagaaaacaaattcacatggcttggatcctacccaaatagtttttattatttcattaattcatttgttcatctctatatttatttctgaacacattcattaagtgcctatcatgtcccttctctaatcgttatgacgagtttttaacatacaagacaattttatgaccctcaccttaaagactatgttatcaggatactggaatgtaacattatttactgttcctaaacattatcaaatacacatactgcagatactctgaaagttgtgaaagctttaaataattcagtatgcagttttgtggctcatatagaaagcttgatgggccttgtgaaaagctgtaggcattgcccatgtctaaaggataaaagcggtagatgacagtactccatgtaattattttggctgtctcacaggcttattgaaatttccttggagtgacatcaacaagatggctatctagaagctcctagcatccttctttctaccacacacacacacacagacacacacatacacacacacacacagacacacaaaaaagctatgaataatcaagtactttttgaccaaaataactaaaggagagctctagagaatagcaaagaagcagcagaaatcctgtagagcatagaaacccaggatggctgcatagggaagggaaaaagatacctcgcctccgccactccatcccctcagttggaatcagctcagaaccagggaggactcctttctgcagggaaaaataaagacgaccccagcaattctgattgccactgcagacacctgcagcctttgttatcagagactcctacagtcctcacaagctctaaactcaactgagagagctccctagagtcacatgctgagctatattcagagaaggtgacaacactgtgccctggcctcacttctccccactgccccctgtcccctatcctattgcctgtactgctactgcactacaccattttggaaccagagacactactagagtgcatcctgctctgggggtgaaacccattgcaccaccctccattcctgagagtttgctgctattgcaacatgcacactccatagtgtgccatacctgagccaagctgctactgtgccctactccctagggccaatctactatatagctgctccatcctgcccattctagttgctggggcacctccacttaaggccaacatccagtgatggtctgccagcaggggatttcagatattctgcacaccagagctatcaactgcacctcaccttctagcaccacaggtgaggcagcttcctgaacctagagactctaataactctggcataccagactagttgtttgccccagcatcacagctgatacagtgccctgctccccaggcatctggcagccccactaacccacatagccatgctttctggagctgagaagacatagtacctgaagtcccaggaaatcacaggagctgtgccactaccatctccaggacaaagagccacagttcctgcatacctgtaactggactaacctccacccatctgagctggtgagatgtcccacctttccagggaatgaagtcattgctgtgctgctccaccaccctcaatcccaggcccaagccacagtggtgccttgccattcctgagtacttgctgttactgtacccaggctcacagagcctgggcttctgtcatgtcccaccatcccagggtccaaactccacactatgtgctatctcatccctcagatcctgagctgcttctatgtcctgttggttccaggatctgaattgtagctgtgcactgttccgtgaggatttagtctctggaaaatcccttcttctccagagctgcaccagtgctgtaccctgtttcccagggtcagaacatagctatattacagcctcctgggtttaagctgctagagtttgtctcaaagcaatagatcccagctttttgggagaactgcatccacttgtgcctgggaatgtgaacctgtgtctcaagtcccaggtgttacagtaatttcacaggacgccccactgtgggggaagataagaacagaatgattcccaaagttcttgccataataacatacatagccaccattattgccacaaattcctgtagcctagaccaccaaggtaccaaggtatgtcagtcatcactgacactgatcacaattgaagaagctgcatacagactgtatcactgggcccacacagaactacagccactgcactttgcccaaccagtaccctcaggcccaccttcggtgaaagcctacaaaagctactctgtaaagtttggaagaggtaactacacaatcagatgtgcagacatcaatgcaggaacacaagaaacacagaaaacaaggaaacatgacatcaccaaaggagcacaataattctccagtaactgaccccaatgaaatggaaatttacaaattgcctgaagaggaattcataataatattctttattattaacaagacacaagagaatacacataggcgattcaatgaaatcaggaatataattcattatctgaatgagaaattcaacagagagatataataaaaaagaacagaaatcttatagctagtgaatttaatcaataaaataaagtttaaaaatacaatagaaagcttcaatagcagactagagcaaacaaaggaaagattctgtgaacttgaagataggtcatttgtgacttggtctgacttagaggaaacaaaagaaaaaggaatgaaaaagagtgaagatattctttgggacttatgggatatcattaagcaaataaatatttgcattatgagattttcaggacaagagattaaaaaagggacaaaaatgcttatttaataaaatagtggctgacaatttcccattttgggagagatatggacattcagattcacttagctccaaggtccccaaacatatataacccaaagaggttctctcaaaggcacattatagtaaaactgtcaaaacttaaagacaaagaattttaaaagcagcaagagaaaacatcaagtcacatacaagggaatctccattagaatatatcagtagatttctcaacagaaactttgcagacaaggagacaattggatgatatattcaacatgctgaaagaaaaacctttcagctatggctgttatacccggcagagctatccctcagaaataaaagaggcataaaatattatccagacaagcaaaagctaaatccatcaccactagacccatcctaaaagaagtgcttaaggaagtttttcaaaaaaaaaaaaagaaaagaaaaaaggcattataattactgtcataagtatatatgcaactataaaactcactagtggaagaaaatgcatagtcaagttcagaatactccagtactataatggtggtatgtaaattatacatctgcttagtatgaagattaaaagtcaaaatggtcaaaataactacagcactacagctacaataagttgttaagaaatatacaatatgaaaagatgtgtgacatcaaaaacataagttatagggggtggagagtaaaagtctagagtttttgtatgtgatagaagttaagctgttatcagcttaaaatagctgattaaaactataagatgttttatgtaagcctcatggtaactgcaaaacaaaaaacatggcagatatacaaacaataaaaagaaaggaataaaagcttaatactacagaaaattataccacaatgatagacaacaagagaggaagaaaggatcgacagagctacaaaacaactggaaaagaaataataaaatgacagtaagtccttacctctaaatgataacctagaatgtaaatagattcaatcctttaataaaaagatggagtggctgaatggataaagatacaatccaattacatgccgcttgtaagagacccataaaagacacatgtaactaaaagagagcaagagtggctacagttatgtttgataaatcagacttcaattaaaaaaactatcagaagagacaaagaaggtaattatttaatgatatagtggtctgacaatcaagaagacttaaaaattgcatatacatattgcatatatatatgctatatatatgctatatatatgctatatatgctatatatatgctatatatatgctatatatgctatatatatgctatatatatgctatatatatatgctacatatatgctatacatatgctacatatatgctatatatatgctacatatatgctatatatatgctatatatatatgcaatatatatatgcaatatatatatatgcacacacacacacgtctccaacattggaacacctgaatacacaatgtaaatagttataaacctgaagagcaaaatagaaatacaataatagtagggaactttaatactcttttcagtaatgaatagatcaaccagatagaaaataaatgaggatataatggactcaaattgcacttttgaccaaatggaccaaacagacatatacaaaactgtccatctaatagctgcagaatacacaacttttttcacacatggaacattctccaagatagaccatattttaggccacaaaacaaggttttaaaaatttaagaatatcgaaatcatacctagtattgtttcagaccacagtagaaattagtaaccaagggaatcttgaaaaattaacaaaaaacgttgttgtggaaattaaacaacatgcttaaacaacaaatgggttgaagaataaatcaaaagagaaattttaaaaatatcttgaagccgagcgtggtggctcacgcctgtaatccggcagtttgggaggccgaggcgggcggaccacgaggtcaggaggatcaagaccaccctggctaacacagtgaaaccccgtctctactaaaaatacaaaaaatttgccgggcgtggtggcaggcacctgtagtcccagctgctcaggaggctgaggcaggagaatggcgtgaatctgggaggcgtagcatgcagtgagcagagatcgctccactgcactccagcctgggctacagagtgagactctgcctcaaaaaaaaaaaaaaaaaaaaaaaatcttgagataaatgacaatgaaattacaacataccaaaacctatgggatgcagccaaaccatttctaagaggaaaatttattgcaataaatgcctacattaaaaaaagaagaaagatctcaaatagatagtctaacattatacctaaaggaactagaaaaagaagaagctacaccaacgattagcagaaggaaaggaataataaaaatcagaagtgaaataaataaaatagccacgtgcagtggctcacacctattattgcagtgggtcatacctataattctagtactttgggaggctaaggtgggtggaatgccctgagctcaggagttcaagaccagcctggggaacatggcaaaacctcatctttaccaaaaaaaaaaaaaaaaaaaaaaaaaaaaaaaaaaaaattagctgggtgtggtgtcatgtgcctgtagtcccagctacttgggagattgaggttgggaggatcacttgagcctgggaggtggaggctgccgtaagctgagattgtgttgcttcactccagcctgggcaacagagtgggaccctatctcaatgaaagagaaagaaagagagaaagagagggagagagagagagaaagagagagagagagagagagagagaggaaggaaggaaggaaggaaggaaggaaagaaggaaggaaggacggaaaatagagaacagaaaaaccatagaaagaatcgagaatatatttttgaaaacaacaaattcaatatggaggccatttgatttatgagaaaaaggaggaaattctaggaccatgctgaatgggctctgatgttgagtctgccattttctagctgtgtgactctaagcaagttatttaatatctaagccttatctataaactaaggatagtgattacttaattcccaaagtagttgtgatgatcaaatgatataaattcagtaaaatattaaaagtgatggggtaggatagtaactcaagtgtaatagtgatagtgatactaacggtgactaatattagtgagcaaacatgatgttcccaagactgcacaaattattttccatgctttatctctcatttcctatggtaagtgcatcagataggtactgttattttacccattttgcagataaaaaccaaggcacacagtaatccagtaatttgctcatggtcatgtaaataaatttgaacccaatttcttgttagcactctcttctccttataatgttctttttatcccttcagtaaaaataagtaaaaatattaatgtgtatgttttaccacactgctgtactttagcatacagtagacattgtgaacattttaaggtcataggctgaatttccttcatagaaaagaaagattactttctttcatatatatattctatatagctctttttcttctaaaaccacatatctacaaccagcttggaatatccttacctaatatctttgtttctttttctcctccttctcaaaatctttttctctactagctctttcttcattgtttattaaacatttcttgcccttaagaaagcaccttttgttatactctctttctacttgattgggtgtgtattaatcagtacatactaggttgctagtgtcagaaacttaatgtaacttaggaaaagtagaaatgtatttatttacggaataaaacaattaacaagaagagcaggtctatagttggataacggaaacaactggatcaaaatatatgaaagtcatagggaatggaaacctcatctctacctttttctgatactcgatttaattttctctgattgcagaccagcttcctctgtgtggtggtaaatctaactgacacaattctagagcctcataaatgaacagtttcttctaatggcaggagcagagtcgtgattctggttccaaaatttcccaagaagggttctgattggtctgatttgggtctgtatcccacatgcttgctgacaagtaggtagtggtaggtcaggtaaaatccatttagctcctactaaaggcatgaggatggagaatgtaggcaaaaggaagttttcagacatcaggaaaatactaagcagaaaatatcatagatgcttccttttttttttttttttttttttttttttttaaagaggcagggtctttctgtgttgctcagactgctcttgaactcctggagtaaagagatcttcccacctgggattcccaaagtgctagtattacaggaataagccactgcacctttctgccttctcctcttaaagttgctgttccctttaatactcttcttctattgactaaattttgccaagctttgtaactgttctgagaaatttctttgaatattatacttgtcatctgttatctcttcaccagatatttttctgtctttttttcttatatagaatttgaggtttgggttggatatttgaatatagcaatatttgaccatatttatgagaaattacttgaaactttctgctacattcagcatagagaagagttggtttataaagcatctggcttattggagaaattttttccttcagtttctttcccaataaatgccatttctgctaactcttgattagactacaaactgatctctgtaatacacagacaagtcctataaatctgtctttaatggttctcattcaattaaagtcttttcattgcttaaatctttctttcctcagagtagtagaaaaatttcaaactgaacggatttcaatttcatctccttacctggttcaatagtggtattttgaggttggctggctgctcaaaagaaatttttgttcttgaagtcatgtaaatgtactagggtatgtttaatgttgaccatatgagtcagtttttcctaaggcatgctgtgctttgacaatatatagattcaaatcatctactatttcaagaatttgaaatactactatttctgaattatgtttttaaataataattctgttccattatttctagtttcctttgggggggctttctttaatatattctttgcctgttctacattttaattactttttccgtctaataactttttaaaaatgagtttctttattgtcactttgttttgttgccttttaagtcctctatgcaccttgctgtatttttccttccttatatgtcttctaattttgcctttaccttttttgagttttatttcttttacttttatttcctgagatctgctagtttccatttcatgcatattgctgtttcaccatctctcttgtgtgcttttttatttctgtactatgttcttgctttacagaggcaactacttcaatgcattttactcatttgttttaaaatttatcacaaaatatttgaccatagttttcatctattttgttgcaacttgttttcttttcaggatactttgccatttgaccttcttatttttttttaatttattttccattatattattatatagatcctgttcttccttgcttcttgttttactgcttattatcaaaggacatgaattttccccactagctatttgtaagcagtttatatagggtgggttgggaggtaaaacagaaccatgcttagggctaaaaattactcaatatgaactaaaaatctgaaaaacctgaaaatactcactataagaaaacaatttcaaaagatattaaatatctgtaaaaagttttcaaagatatctggtttggtgagttagtgtttccaattatgttagtaagcagcagaactgggttttgaaacaaggggtatggatgtggattctgcaatgtttacccaggtataagaccaaatgaaactagcaagttaaacataaacaaaatgacagagccaattgatatccaactagtaacattcatttaatctgataaattctgctgttttgctgaaatgaaattgcccttcataaggtgaatatagatgagaattctgctccatatggaataaactcacatcattgtgagtttatatggttctgtcatcactgtgggctgtgtgctgagttaattctctcaccattttttaaacaactgtgaaaccttcctttgtagagttgcctttatgacatttatgacatttggccaagtcatttagaccaagtatgtcatttacacttatactttggtcatttagaccaaatatgtcatttacacgtaatgttagtcttctttattttctcattagctcatgtcagtataaatggaactacttgacaccaacataaacattagtgcaaagacaagtgtgaagaccctgtaatcacatggcacttttcagaaatatgaggtcatccagtgattctacaagaggggttggcaaactgcagcttgtaggccacatccagtttacccctatttccataagacccatgagttgagaatagtttttacaattttaattgttaaaaaaaaagaatatgcctcagagacatgtgtacttctcaaagtctaaaatacttagtatctggccctttaaaagaaaaaggctgctgatccctgtcctagaatatacttatgtcatttttaaaaatggttattatgagatgaaagcacaaaatgaaaagcatcttttagaaagcttcaggatacttgggaatactttttcagaaagcagggaagaaaacacatttctacctactgaaaaatgtgctcagtaactcatccccaatatttgtgagttaaaagcacaaacagaccattacgtgggagaggcacaacaattcttggcactaagattaaatagaaatcactcccaggattgtcataaagaagacactatggaagataacgatgtcttcactggcgcacctacagtacatctaacaagtttcacagggcccttttaaaagacaatttaaaatatagcctgatgacaacattcctaaaaacaatgtagtgaaggcagttttagagaacttgagagtatgggtcagagattttcatttctattaatctgactccatgcaaggctagattgtagactctggacatatgaagaaactggaaacccttaggacaaatctcttttttggtaaaactgttgaatatatgagtagataccctgctacacaactaaaggtcagcttttctatgttgccagctgaattcatcatacccatttcacattatcattacagaagagcgtgacaatgcaaaattctggagataagatcaaacatatgaataacaacatttaaggatgccatgaaggctatttgagacaggtcctctgtccatgtgatgcaaaaatgacagaggacacatcagacataatttgtcacaacccaatgacattcatgtcagtaggtgctgagatgtaatctgtcatgttttagttagaggaaactgtatgtagctcttttgatggattgataagtagattcatccatccttatactttgaaagaacataattattcataattatttgcatgtagttatttataaacacaaccctttacattttatcagtaaatgtcaagagttgcctcactcggtgcactttatgctagtttagctaatttgcttaaattgggatgcccagagcccaagtatatcctcttgtgtcctgggaaacccacccttgccctttgttaaaggagtagcagttccatacgctggatggattgaggaatttcccattattgattaaaggtcaactatactctgggttctattaaataggtacacatgaaattaattaagatgaactagttaagacaggttcaccatttggagccactctcccccatctccacctcatcatgcaaatcttttttatggaagctctattcagcttagatatttaaatcagctctcagtaacttatctaccataaccgtttacttagttgtcctctctcactctcagcaaaatcaatgagctaaaaagattaggaaccatcattctttgtatttccagcacccagcccagtgatggtgtgaggacacatctgttactccacaccttctattctcagcacaccttaagctaaaacaacttgtgtttctggcacagctatcggagactttcagaggtgacaaactcatgctcatttatttagttgcctaatttctccagtgtcagtaataatctatattcttagcaaatcattgggaattggaaaccactctgacagattaaggccaggaaattttttaaagaagaaatgcaagaactggaaattacatatgtgaccttgtgccattcagcctgtgaatggtgtgtgggcttaaaaggttgttagggttgggatggtagaatatgtagagcttttggagaatgttttttgttactgttgtttgacctacttcattcccttcagactccgagaggtcataacacacgatataaagtgcaaggttaataatggagaatgtcgcattcaggagtttctctgcctagatgtggaattctggcttataggctatttctttctgtgtgtctctttctcttcactcttgaaataagttaagaaattctcaacgactggaatatatgttttccaccttttctggccatcaactgcgttatcaggatgaatgtcaattactgtcattctggaagtcatagggtgcattatcctgttttcctattataggggtatttgagtaataaacttactctcttgtaatatcatataaaattttattttaactgacatctaaaagcacgaaacctcttaaagtttggcttgccccatggaggtgaatgcagctgcagctcatctcaggagtctgcccttatatgaactgcttgttcttacctttctactcctcagcatgttgaaactcagaccacactcctaaatgagacatccaaaggctccggcctgctggagtgctgacaagcatgctgtttagggcaggtactcagaggcaaagtcagagaaacatgatctcttcagcagcacgtttttgcacatgaaacctgtgtaaactcagcatgactcactcaggccaaggtgagcactctgatgtctgtgaacgactgcagcaacttggcaactggggccagtgtgcttccctgtagcactcagcagagacagttcaggacttgaaacaattttcctcattgctgttgtcactggagaacaaaaactgcaaaagcgagccattgttcacactgaaagtcattttgtggagaaaatgagaggcttggaccagtctttttgtcctttattgtatcgtcccctctggcatccatttatgggtctgatttcatttctattttcattttgagacttttctctatgacctcaggtcagagacaatatcaaaggcaatatgttttagtgggtttatttgtctgagtcaacagaaaaagagagagggaagggaaatggaagagtacagggcaggggggaggaaggggggagagagagagagagacagagagagaccaactgagactaaagctatgtctgtatgaaaagatgactatagttggatctggaattctgaatttgcaactaacactgatgccatttacaatgtaacaatcagctttagtcttccatgtgaatgtagatattatatcatcatctcataacattttattccatatacatggtcaccaagatgaacagaaagagttagatctgggtggtgagaactgggagaaaaccagccatgagaataagatggattgtcttttgtcacagaaatagcaaatttttaagtgtatttgaaatgataaatacttttttttaaccttttgtaacatttcacaaaacttttaaatcaaatttcaactggaactttggtctgctttccttaaatgcagctgatttcttgctaaattccattgcatttgatgccttcagggatttgggaagttagcgtactgggacagaggcattgatgatacatatgacgtggacaaaggaaatgaactcagcatatgtgggaagtatagcaagtgttcacttgtggccagtgtcaccaaaaatgccaccaaggtaactcaacatagtcaaagtaatgaggcagaattgttcttcagttaacttgttaatagggaaactttttataagcctaactggtctagtgatatttggtccagttctcaaacctatcttagaggcttccctgtctcatttccatagggaaaaaactccctatccaattattaaatggataaataagtgcttaaaacgtgaaaaatagggaaattcatgctatttgaactagtttttgcttaagtatgatatggccatggcaccaaacttcagtgtgtatttaggatcaccttagatgcatgttgaaactatacacatacagcctaagctaatcctaatgaacctgcttaagttggtcttgagtgtggcctaggaatttcattgtaaacaagtatcccagatgattctgatgcacatagatgcattctgatgtgtgtgtgcatgtgtgtgtgtgtgtgtgtgtgtgcgcgcgcgcacgcgtgcacgccagaggggagataagggaaagatttcaagttaaaaatgggtttgggttactttgtgaaagaagttgaatggcatgctaaggagtttgtgtttttaaataaagaacaaacgtgatcatatctgtactttgagaagtataactctggtgacaggacggtttgaagagggaggggagaggagtcaagaagactagttaagaagtttttcaaaagatgagcacttccgccaaattcttcatcacacattgtacaggtaataaataagacatggttcctttcatgaagttgcttatgatcttgtaggaaaagattcaatgaatgaggcagagatggagaagtcagagaagtggcttggatgggcaggttggggctggacagattttgcagagctttaagaagcaaaggaagagcagattcccagaaaagaatataccctaagagacaggccactaaattaaatgacagtttgatggtgccacttttttcccccactggggtgtctggactctacagacttacataaatgagcagtgagaaaatgtaagtacagattattgattacttttggggacatgtttgcgtaaagaaagacagagctaaaatagcagcttgaagatatcaaaggctaaggaaaggcaatttttgtgttgttttgcttttgttgtgagtctgttgttctttataggggagattggaatatatttccaggaaaaagggaaagaaaatccaaaacctagagaagtgaatgttggtggggcaaagagaaagagagcaggaatgagaccaggagggcaggtgaggtgaagaattcggtattgggaaggaagagaccagaaagctgaagaggatggatggctacacgatacctttgagactgggaggaagcagcaggagaaagagataaagaacaatgagagatatgagttagacactgggatatgagttagacactagtcacatttcaccaagggaagagtccaagcttaaacatatttttcatgtcgcaatatgcttagggaaagctggcccctttccgaatcccggaggatgaacacgtgattgatctaaacacggcatagctatcccattctcttctattggagttcggtttggggatgggcaagtgaccaactttaggccaaatattaaggagatttcttctgagggtacttctgggaagtatttgcttcatgatatatacatttcctcccttgaacttgatagtataaaggcataatgcttgggatgagggaaccatcttggaaccatgaggtgcaaacttaaggacctaagttaaatactaaggataggggaggagaagaaatctgagtctaatgataaccttgagacagtgtggtatctctgggactgcgtacctccaatttcttgtttgtgtgtgagtgtgtgtgtgtgtgtgtgtaatcaaacaataaagaatatatgtatgttctttcttgtttaaatcacaactattttaattttgtgatatttctgttaaaagtatatgtaagtgatgttggaaaaattggtctccatctttttattaaagaggtagtcatgtgcccagaaggatggaggcccacctgtgatttagggttgggatgtgtggaaaatacctgaagctaccattgaagatactgagaatggcaggaagctaatgaaataaatcaaagaaaggcagcataaacagacctcaaataaagtaggactggatgtggacagaatgactttgcaacattgccaaacctcaacaaaggggcaaaaaaggatagagtccttgttgaggagggtttaaaattggataccagaacacagcatcaacccaaagtcaaaggcacaaaggtgtcattgaggggagcaagggcagatttaaatgttttatgaaggagcaaaatcaggattaggattggatagtgcttggacaactcatacaatatgtttttgcctcagttttgtcattgctaaaaagtaaaattaacagctagtgcttaggtttttgtgagggtaaaatgggataatgtataatttattttacatggtatctaacatatttttaagaactcaacaaatgtggtaataattagatcctgaacttctgtcaaagccaggcaggggggcactaaagaagctcacacaacagaaataatgtcaaatataagtgcgacatatatatttttaaaatcagcaagatgtataaacaattctcactattaatactagtaagtttcttcaaagttgaacttaggaaacaggaaaaaattggcacagaacatcctgtgtatcttaccaagataaattccaaataaattgcctgctggcagtacccattaattatttgccgacaatttttcagccagcacatgcttttttatttagctggtccagcaagtcactgcagttgtagttgttcatcttgtcacaggactgggtagaaagccaaatgcagaggtatgagctgccaagtaacccactatctgtgcagctgtggggaggaaccagaaaacctcaagacttcttgctgcttccattttcctagttttttttctctagaacctcatccacatcgtatggtgctgggaagggtcccacagcgtcagtgtcttctatgagtttgttaaaaatgcagactcccaggtcccatcccaggagaactgaaacagaatttgccttttgataagatgtccagatgatttgtttgcacattaatgtttgagaaccactgatatttaggacttatctgaagccacctcacaggataggcagagaatcgctgtttcacccaaaggccctctcatttccttgtcatcccttcatgatgctggatgtggggttcttaagtgagacctcatcttcactaaatctctcattgctgtgcccactgaagccagccttcagttaccagggagcattgccttagaccactttaaccagagagcaacaagctcaaggaaattgtatgaactcaggtgctagacgttcctgggtttattctaggctctgcctcatattagttgacctgggacaaattaactcaactctgtgattgcacctctccctccaagcaagagcctctgcagccctttttcgtaactgttgacccttttctgatggccatcacaggtgggaccaagggagtacactaggggatattagaggaggatccctaatacaagattggccaataagctttgcttcctaggacatctggatttggaaatcagaatccactagttgcctttctcagtgtttgagcaaagaagaattataggacgacctggagaaattatttctcagcaatgggctcagagatacagaaaaaaacaaagacaatatggctgtagaaatatcagtcttcatttctgatagttttctaattttggatcctgctgtctactgaagtctgcattctgcttctgggttccatccctttattcatctaataatttatctctctctctcgcccacactaaattaaattccttaaatccacacagtcctgacaaagcaataagctttaatgaatggtagttaaaatgattattattgctactactggctgatcaacttaatcattattattgtaatgcctcctatatcagctgttttttcattcaaacatagtcactgataattgatcctcaaaatggtaagaaaaccaatcatctgaatcactaggaaaaataaggaaatactattttcatatatgtttatgtattcactattgcattgatgttcaaataattaatttaaaatagaatgatgtctaccataattatagagcacagtggcagctgtcatttaagagcacattttaggcctgaacccctgcaccactgagggaaggaattgtctcagccttcaagcctatcgtgtcccatgttattactcagatatcacaggagacctaactgacatcaggaaggtaaactcagtgacccaggaaacaaaactgttaagttataaaatgatgttaagaatccttgattccacttgctgctgtgggtctcatataatatactcccctccaagcccacagagccttatctcagctggcagcgatctggaaacctacctgttacattaatcaaaacatcttactggaatgctaacttcttgcaaagttccagctcttttcatcaaaaccaattatgtatgaaatgttagacattgtccagtggaagatatatattatcaatattaatgataaaaatcacaactaacatttagacggtagcatgtatcacacccctttgaaaaacgcaacagtattttcagctagtcatcattttctacggttttgtagtgagacatgtgagacttttaagaggtcaaataactttctcaaggttcccagtttgcctgttgcaaattacacttctctgacacatatggatagctctgtccagtgaacactcttagaaacctttaagtaggctgggagtggtagctcatgtctgtaatcccagcacttttggaggccaaggtggatggatcatctgaggtcaggagttcaagaccagcctggccaacatggcgaaactccgtctctactaaaaaaaaatacaaaaattagtcaggcatggtggtgcacacctgtagtcccagctacttggggaggctgaggcaggagaatcacttgaacttgggaggcagaggttccagtgatccgagattgcacccctgcactccagcctgggcaacagagtaagactccatctcaaaaaaaaaaaaaaaaacctttaagtagaaggcagagcctttctcaacatgctacaccattaaaatgtcacatgttccttttttgagaggtagggagaacactttagggagaaattgtctcttcttcagagatgtggctggcaaaaaagcaaagggaagtcgggacactttccaaaaaagcaagctacgtagggcgcagactgcgggcaagacaaaagacctctccagccatcctgaaacattaaacccaatttccttatccccagcaggtatctggcacaactcgcatcattacaattttctagtgtactgagctggggaaatgtttccaaaggaaactgagtagttaccaaaggaagagttgaagacactttgccaattctcttttcttaaggacttagtaactcagactttttaaggtaggaaagattttgccttttgaaaataactagagtttttgctaccttgacaattttaagcaacactgaaagaaccgtggaggttgtataaaccatttgaatttttccgtcatagacctaataatcaggactctggaatggatttcatcttttcttatcaaaagggctgctctcatgctcaatcagctattctgtttcttttcaaaaccgattttgtgttagccatggggagtcaggcagtggattgtctaaatacttttatacagaaacaaaaattcatgcttgatgttcaggtcagttttacagagttgtaatttagaggcattcaagggagtttaatggagaaggaaaccagtcaatattttattcaatccaaacatgaaccaacattattaagtcgaggaatctttctgctgagaaaataatgtcacaaaggttcagtcaatctctgggagaggaaggagggttcataaaagactgcacagtttacatgtgttgtgggaatttaaattttagtaattcttgatgcagaattggacctgtggaattagtcccattttacctccataggaagtgttcaagccagctttctaagcagatttcaaattctgcgtttaattacatttcctaaaacccttagtttgcacacacagcccatgctactctggctccgatgtccttttcagttgctggttggcccttcttcatcaggagccctgttctcgactaaaacccagctccacgctgctcccatcctgctaggcatggtcatgatcatcccaatgcctgcaatgccccctctctgtccagggaatgctttctgatctttaaattcctgaatcaaatatcaccttcccccttttcgctcctcttatgctgcctaacaagcttaattattcttatttctctgttttacctttgctatcaccttattgccatttatcatggtggctcattttaccttttttttttcttttccttgattacaagctctttgaggatcttttttttttttctttcctgcctggtcagtgttcaatacttactgagtgactgaataaatatatatattagataatgcaattactatggattttaaaatctaagatcaaattattacatttgttgtataatcagatattttctttgaaaagttattctttctccaaccagtaactcctctgagcaagtggtgcaagcactgcctaacttcttgagcgtagagtatgaggagaaggagcagttgggtacccacaattgtcaggataccaataatctgaattgtgggtaaaaaaattattctttagagctatgcttttggattcatggcaagttgatgttcacagggttaactgaaaataaatgtctactgctgttgtgcactgtaaattgggtgcaagttatatggcctccactgttcaagatatatgatgagtcgatttctaatgattgcaatacctcatgagataccttacccactcagttttagagataggaaatttgaggttcagaggtgtcaaaatgatgtctccaataccaaatagctaagtaaatgttgaaactaaaaggggagccccctgccaaagacatcctatgagtagcaatagaatagccagaagggcagagtattggggtggtggtggtggtatcagttctcatgattttaacccaaaatgacagtctaagaaggaaagttagcatagaatattctggtagatatcatgaaactcccactccaacttatcagaagaaaagcagcccttttcagaagcagccgactctagcccttggtatgtcttgtcagtggactggctcagatctcataatagtgccatcccttgggggactttttggaagctgcaaacctcccgacagaagcgctgtctaatgagagcctcattcctccaagtgctaagggcaagagtctgggcagaaggatgtgtgtagtgctgttgtgagagaactggttggtactgacacctgaaaaatctccactagcttttctgcaaattataacattaatatgcttgagttcagccattgggaaattaaacctaatgtactatagataaaagattgtaggccttattcaaaataagattcagaattaaagaagactatgcatggtacctccagaaacactatgtataatattaagtattccagaataatcataagaatgcaactaacatttttggatatttacatgtgacaggcactatgctagtcattctatatatattatctcttttttttttttttttttttttgagatggagttgactcaccacaacctctgcctcctgagttcaagcgattctcctgcctcagccttctgagtagctggggttacaggcatgcaccaccacatacagctaattttgtatttttagtagagacagggtttctccatgttggtcaggctggttttgaactctcgacctcccaaagtgctgggattacaggcgtgagccacagcgcctggccttatgttatctcacttaatcctcacaaagaacttatgatatacacaaacactatcattatctcgttttacggatgagataacaaagttacactgttaataactaacagaactagcacacaaactatattatgctgatctactcattttccattcaaattaattgaggactgaagacccaaagatgaagggacacaacatctgctcccacagtatgatagggaaatgaataaaacaaaccaattgttcaatggaactatggcactatggcataagagagaggcagaaatggtctggtaggctaggggtgggcaggggggatttcggagctatctgagacttggaataataaaaggagtttctaaggtagaagaatcaaattataaaactggcaaaagaacatagcatatgctcagagaatgatgggttgttatagtttgaatggatgaggtccctccaaaattcatatgttggacctgaataatcaatgtgataatattaagagatgtggccttttgagaagtgattatgtcatgagtgcttcgcctcattaatgggattagtgctgttacatgagaggttgaaggaagcactctaggaccttcagctcttccaccccttctaccatgtgaggacacagcattcatcccttctggaggatgcacttccaaagtgccgccttggaagcagagagcaagcccttaccagacactgaatgtcagagccttgatcttggacttgccagcctccagaactgtgataaataaatttctattattgataagttacctagtctcaggcattttgttatagcaccaggaactgctggtaccaagcagtggggtgttgctgttaacaaatatataaaattgtggaacaagataatgcagagaggctggtagattttggaaccgaatgctagaaaaagtctctattcctgtgaataaagcattaaggcagttctggtgataactcaaaagagaacagctgtaggggaagccttaatcttacagactacttaagtggttgtgatcagaatgctgatacaaatatggatggtaaaggcaattctgatgaggccttagatggaaatgaggaacgagggattgtaaactggagaaaaagccatcctgtttataaagtggcaaataacttggctgaattgtctgtgtcttagtgcttagtcagaagctgtgagcaatgaactagagtatttggtggaagaaactgctaagcaaaatattgagggtatggaacagcttctcttgactgcgtatagaaaactgtgtgtgagagaaacaaattaaagatggaatttatactcaaaaggcaaaaagaactcaaaagatttggaaaattcccagcctggccagattgtaaagaataaaaaggtgtgttcaggagggaacaccagggtgtgatcaagtgatatttgataagattagtgtggatagaaggaagccagatgcaattcagcaagacaatggaagaatgaccctgaaggcatttcagagagctttgagggtgctcctcccatcacaggcccagaatgccagggccttgagagcagaatgggttcaaaggatgggggccaaggtccctgtgggactttgaggcttactacccagggccaactcaatttctgctccacccattccagtgcagtgctctttggctgctccagcatggctcaaacaggtacaggtttaatgcaggacactgctccagaaagcacaggcagtaaatcttggcagcacccacctggtgctaactgctggtgcacagagtgcccaagctgtggaggcatagctacctccacctaggtttcaaaggatgccttggagagcctcatagcccaagcagagaactgccacagtggtggggccacctcacagagcctctactagggtaatgcctgatagagctatggagtattccacccatgagagctgctgtgagggctgtgcccaactaagccatggacgggtcttccctgggttttgggtcccaacccccactcagtatgtcaagaaggcaggacatggagtcaaagaagattattatcacgcctcagaggtgaatgtcgtttgccttgtcgggtttaaatttacttgtgaattattacccctttcttctttcctatttctcccttttgtgatggaaatacctgccctgtgcttgttccacccttgtattttgtaagcatttaacttgctggatgtcacagattcacagctggacaacaatttgcttcagaatgaattgtaccttgagtctcatccatatccgagttagatcatatttacaggagactctggacattatttttattttttccttaaatagtgtttgaggtacaggtggttttttgttacatggataagctcttttgtggtgatttctgagattttggtgcacctgttacctgagcagtgtacactgtactcaatatgtagcctttgatctctcaccccctcccaccctttccccacaagcccccaaagtccattgtatcactcttgtgcctttgcctcctcatagcttagctcccatttataagtgagaacatacaatatttggtttgccatttctgagttactttacctagaaaaatggcctccaactccattcaaattgctgcaaaagacatttttcattccattttagggctgagtagtatttcatggtgtgtgtgtatgtgtgtgtgtgtgtgtatctatgtatctctctctctctctcacacacacacattttctttatccacttgtttgatgggcacttacggttccacatctttgcaactgcaaattgtgctgctataaacatgcgtgtgcatgtgtctttttcatagagaattcatgactaagacccccaaatcaaatgcaacaaaaataaaaataaataaatgggatctcattaaactaaaaagcttctacacagcaaaagaaattatcagcaaagtaaacagaaaacccacagagtgggagaaaatatttggaaactatacatccaataaaggactaatatccagaatctacaagaaactcaaacaaatcagcaagaaaaaaacaaataatcccatcaaaaagcaggccaaggacatgaatagacaattctcaaaagaaaatatacaaacaaatggccaacacacatatggaaacatattcaacatcactaattatcagggaaatgcagactaaaaccacaatgagataccaccttactcttgcaagaatggccataattaagaagtcaaaaaacaatagatgttggttggtgaggattggtgaaaagggaatacttttacacagctggtgggaatgtaaactagcataaccactgtggaaaacaatacgaagattccttagagaacttaaggtagaactaccattcaatccagcaatcccaccactgggtatctacccagaggaaaggagtcattttgtgataaaagagactctgaactttagaattttgagttgtcgctggaacaagttacaatctttgaggctactgggatacaaagaaacaatgcatttcgcatgtgagaaaaacatgaattttcacggggccaggggtggaatattattgtttgaatatatatgttcctccaaaatttatatgtcagaacctaatacccagtgtgttggtattaagaggtgggaccttttgagaagtgattaagtcatgagtggtccaccctcaggaatagggttactactctcataaaagaggttgaaaggagtgccctaggccctttttcccttctatgtcttctaccatgggatgacacataatttttcccctccggaggatgcagcaacaaggtaccttcttaaaaatagatagagagcagcgttcaccagacacttgatctgccagtgctttgatcttcaacttcccagcctctagaactgtatagtctgttcctgctgctataacaaaatactttagactgagtaatttataaacaatagaaataaattatggtttacccagtctaaagtattttgttatagcatcaggaacagactgaaaaatggatactatgtcctgtatgactggcgcatagaatgtgaaacagagagtgacagggcatcagagtggaatatgggaaaaggccaaatcctgaaggtccttgtatgtaatgcaaatgaaataaaattttatttaaataaaaggatagggagccattgaagaatgtaagtagagttggtatcaatagcgttgctatttatgatgatcatgttatggagtgaatgagtgtgtgtgtcccctaacagtcataggttgaaattctaacccccaatgtgctggggttatgaagtgggacctttgggaggtcattaggtcatgagggtgtagccctcatgaatgggattagtgcagttataaaaagacacaagaaagcttgctttctctctctgctcttcaccacatgaggctacaaggagaagcaaacaatctgaaccaggaagcaggttcttaccagacataggatctgctggaaacttgatcttggatttctcagcctccagaactatgatcaataaatttgttgtttaagccacccactccatagtattcttttatagcagtccaaacttacaaaaatatatcactttgatggagtgtagtgaatggactgataatggtgagactagaaataaggaagctaatggagatattgcaatagtcaaagccttaaaattgagtgggaggagtcggaatggaaagcaaataataaattccagagtatgggtagcatagaatagtggctaagaatatggcttctgggctggctacttaagcttgaaccccagcactgctacctcctagctatgtgttctttgggaacaccattagcttctgtgtttgagtttcctcatctataaaattcataataatggtatctacctcatagtgttgttgtgtatattaacatgacatttgaacatgttgctgaatattaccgtacagttatgcactttatgtgatgtgcctaagtgtctagcacaaagacagcattatgccagaggcatttgtgtctgtgtgtgtgtatgtgtgtatacaatctatatatactttttgctcatcacaatgggcaaaattatttttgttataaaattgtattctaaagtaaatttaatttacttaaaattatattcaggacaagtaggcacaaaaattagcctggtttagaatgacaaatatgtataaaaattaaaaatgtgattctttaggccaggcgtggtagctcatgcctgtaatcccagcactttgggaggctgaggcgggcagattatgaggtcgagaaatcaagaccatcctggccaacatggtgaaaccccatctctactaaaaatacaaaaattagccgggcgtggtggcatgtgcctgtagtctcagctatttaggaggctgaggcaggaaaatcgcttgaaccctggaggcagaggttgcagtgagccgagattgcacttctgcactccagactagcaacagagcgagactccatctcaaaaaaaatgtgattcttcgacatttatgtttttgaggtccttttaaagtcctatagttgcatggtataatgactttggagatagaatgtttcagaataggtaacattaaaggattgtcccatgtaactggattctcataattgcttttttctttttattactacttaatacatatcctagataacccagataacttggttttgaagaactactaaaacacaattaagtattatcttttaccctaaatgtggttagactctctgtttaaaattattgatttttggatcccatatgctctggaaattttagtgtgttttaaagcaaaatataagagaatgtgaaccgagggatattttactctttacagcatgttgaacccaaactctcactagtatctcatcgtatttcccaaaggtttgccaggataaacttcagaagcagacagggtgccttggctcaaggatttgagaaatttggtcttactgagagaaaatagagtgagtaaataattattttcaataaaggattgacctggtcaattttacgttttttttttttttttttttttttgtaagatctgatgttgggatgaggaatagattgatcagaagatagttgtatggagacaattagaacattcctaactacttcataagagagatgatgtaggcatgagttatggcatgtaggactggacttaagaggaagagaaagaactgagaaagtggtagaaaaaaatctcatagaacttgatggctgattgaatttgaatgactagggaaaagaaggagtcaagaatgatcccacatttctaggctgtgtaaccaggtagaggatcatgagccccaactgacagagaatgtggaagaaaatgtagctttggggtatggagaacagaacgtttagttttggacatactgaatttcaaaggtctatgccagagctaggcaggcatgaccagcagataatgggacacacagctccagtgagaggtgtgggctggagatactaatttgagatttattaccagaggtgggagatgagtcatgaacatgggtgtgctcttcttaggagaatgcaaattgcagagaataattggtcaagaacagaaccctaaggaacagaagtgcgtaaagaatttgtgtagaaatgaaacccttgaagatgaaagaattctggattagacatgtaggaagaacaccacggaaaccaagggagttgacaatagttttggggtagaagggatctattttatgttgtgaaatgtccaattagataaatactaaaaagtttccattacgtttttaaaatagcagactttttttttttttgaaaaccctcttattcagaacaggttcagtggaatgttaggggtagaagccatattgaagacagctgagaaactaatcctaggtaaagatgtggaaattgcaagacctcactttcaaaaagttttgaggagaagaggagaatggcaatactactgtagagcatactttgggaaactctgggaccacctgggtcatactttgggaccaggagaggcatgtgcctatttattggctgagaggaaggagcttatagaaagtgagcagtttaagataccatagagactccggccattgtggctcacgtctgtagtcccagcactttgggaggcaaaggtgcaaggattgcttgagcctaggagtttgagactagcctgggcagcatagtgagacccccatctctaaaattttttttttttttccaaaatttagccagacatggtggcacacacctgtagtcctagctactcgggaggttgaggtgggaggatgcttgtgtccaggaggtcaagtctgcagtgcgacatgatcatgccactgtactgcactccagcctggacaacagagtgagaccttgtctcaaaacaaacaaacaaacaaacaaacaaacaaaaatacaaaagagagagtgatggctaaaggaaaatgtatgggaatgaagaacattctagtactcaggtgccttaactttgacccagaagaaatttttttgtaatgagagcctggaagaaaagagcaaaagaagtaatggatactatcattgatagaactttcagcagagacgcagaaatttgtggcttataacattagatggcatcaatattccccctgagataggaaacaaggtcttctaaaagtgagaaggacagattatttaatacaggggctaaagagaagccccttcctcttgaataaagcctgtgatagatgatcttcaaagaggaccaccatcaacttcttcttcccctggaagcacacactgccacatcccacatcaagaggtgggatttgtttccccttctcttgaagctgggaagacgtgttattgcctttgatcaacagaatacagcagaaataatgttatgccagttccaggcctagctttctaagcatagtggagttccccttcttctctcttagaagccagctaccatgaataagaaattcaactactctgagatcaccaggctgtgagaaaagctaagctagctgaattaatttgctaggactgccatgacaaaataccacggactgggtggctgaaacaccaggaatttattttctcacagctctaagagcaaggcatggacgggattgcttttcactgaggtctctccccttgacttgcagatgactagcctcttgttgcctcttcacatgggaatgcacgtctctctgggaatgcacatccctggtgtctctttctcttcttatgaagacgcaagtcataccagattagatctcatcctaaaggccttatttaacttaaatgtctctttgaaaccatttttccaaacatggttacagtctgaggtactggatgttgggacttcaacatatgaattttgaggatgcagaattcagcatccaacactaaccatgtacagagatcatgagagagagggacaggacagatgggcaatgtggagattcattggtcagtattctgagcttatattttctcacataatcatccttcacataagtctctttaagcacatagagcaaagctgtatcaatttcatgctgcagttacacctttctatttagaattcacaaaacaaaattacccatccccctcaaaaaaaaaaaaaaacaaagaaaataacacatatacatcttctgatggaactaaatctgatatgtaaaatgactcaagaaaaatccccagctagtgagactgtgctactctctattagggtaataaaataacctgctaatatcactggcttctgatacaattgtgatgtgtaatatataggctgggagaccactgtggatatctatttttctctcatttttccttatataatttgggaagtggaaggaattggaaactacaatttcctcatgccttcataatagattctgtacatcctttggaaagtccacaaatctaaaactttaaaaagctacagggatcaggcgcggtggctcaagcctgtaatcccagcactttgggaggccgaggcgggtggatcccaaggtcaggagatcgagactatcctggccaacatggtgaaaccctgtctctactaaaaatacaaagattagctgggtgtggcagtgtgtgcctgtaatcccagctgctcaggagtctgaggcaggagaatcacgtgaaccagggagttggaggttgcagtgacccgagatcgtgccactgcactccagcctggcgacagagcaagactccgtctaaaacaaagaaacaaacaaaagctacgggaagtaaaatgttgtcagtttaattctatgagaaggtccatattgtgataagggaataatattaagtcatgtacagaaggctgatactcagatacaatagtgaccatctacattgcagggtggatttgaagctgtccatttcatcccatcctctgcaatggaatgggaactccaacaccttctccaaagctgagtcgctcactcattctctgttattctcttggttttctaagcagactgtgttccagtttccatttcattctgtattttcttatgcacattgtttgttgaatttttatatccacacagaaatgcacatccctacctccatacctacacacataaaagatttttgatgtatggatgctggatgcaaggactaaagaatcaaaagcccttggaataagagagtactgagagataggacaaacacattttttcaatgttcagacttgctggaaaggagaaaataccctaaagaaagtgtcagaaacccccctttaggcctcttttgttactctctctagcttttcaattggggacgtcagttttgctggtgatggcataggcagggcaaggcaaaattaatataaaattagagaagatacgctataaaccggcagaggtccatctttaaaccattgtgaacaggcaggggttcatctttaaaccattgtgaagtgtgtcttctctaagtttaagacgaaggtccagtcttctccagtggggccagaagcacaagtccttttattttttattttatttttttttttgagacggagtctcactctgtcgcccaggctggagtgcagtggtatgatctcagctcactgaaatctctgccacccgggttcatgccattctcttgcctcagtctcctgagtagctgggactataggcgcctgccaccatgcctggctaattttttgtatttttagtagagacagggtttcaccatgttagccaggatggtctcaatcttctgaccttgtgatctgcccgcctcagcctcccaaagtgttgggattacaggcgtgagccaccgcgcctggcccagaagcacacattgtaagagattctgccttctttgctttcaggccacaaaaataagaggtggggcctggtccttgtaggatttttttctataatatacttttagtttagctagtattatatttctgtgtacaatccatttctgttattaccatggttactactattgtttattatccttgataatcactagcttgaaccactgcgataagtttgaagctgatttaatagcctctactctcattcctctcactctgctctgtcagagtgatatttcttaaacatcaatgtgaccatatctgtggcttgtcctttcggtgatctcatccagtctcacggagataagtatgatatagatgttggtgtcatcagtatttatttcccagcctggacctctcctctgaactctagatttatatatatgcaactacttactccatagctctcttcggatgtctaagagacatcctaactctccaagcaagatgaggctcctgatcttcctctctaaatgtcatcctccctccctcagttctcctttcccatttcagaatgtcaatccattcttctgaatgctttagtcaaaaaggtcagagtcatctctgaataggaactgagatacataggctaaatgacatcatggcatcctcattacatgagtcagtaagtagcagcatcaggatatttactcggacagtgtaactccagagtctttgttctttacccctatgtttgactgcttctctaccttataaatccctttacaggtaatccaaaaacttcatatagaatctaaatgacaaatgccaactgctaacctcaaggcaagcttgctacatcaaagaactatgaattctggtctacctagctgtctgggaaaagagctgaaaattcccttggttgagggccaagatcttttgattcatttttctctctctttcttataccttctgcatgttcttatgggaatcctagattctgcatgttcttatgggaatcctaggctgtgattttgagatgggaattcagaagtttctgttataattctgtctcagctactaattagctatatggccttgggaagtttctaaactttttggtattttataattactctgccaaaaaatgacatgcatacactagatggcccagagtctatagcaataatacagaaaaaatgtatagagaaatagataaatcaaattacagggcctgtttgcttcttgagggaaagaatcacaagtttgtttactatccatctcccaagtgcttattgaagttacatcttcggcagaaactcagtaggtatgtgtgaattgctggttgaagattcatgatttgctatatggtacggacaagatgccttagaattccagaggcagtttggaatagtagaaacaaatctgaattgagaggcagacaacaggatctaatagcagagaaggcagagatgtgtaagttagttgacttcaggacaaacatctatcatatagtcaagacttttagtatttgcctctgtaaaatataaagagagtgggattggttgatctcaaagatatcttaagggagctgtgactgtataatttactttttccataaaacctaaaaagtgtaagcatgaaacatttttgtgtgtgtatctattccattggaagggctcagcaattgagcatcaggatctagcacatataatcatctgtttacatttcatttattttagaccccacaccaatactgtgaagtggataataatatctccatttatgcataaggaaattgaggtccagggaggcttttcaaggtaaaactcagtgtcagagctgggattgcaatccaggattaagtggctctcagtttcaattctctttgcattgaaccacacatcctccccaagtctctggcactagtgatgcacatcaggaggcaatgtaggggctcttcaggatataaagagggctcatgggtacaaacatacagtgaaaaggacatggccacacttcttgaaaaccaggttcatccaactctaacagaaagtgctatgattagccaaaaaatatattctagtcacacacacacaaaactaattaattagaaaaatctggtgattaactgcatgccttcattgttttcaataaatgtaacctgtccaataaatcagtaacatttattaatgataatacaaagtatattcagtaataggcttgccttccatgaggagactaatatggggttttatatggagtcccaaaagaaaccaaataaacattgttagcatttgcttcattgcacagattacatggtgccttgattctgctgctgacaagcagtaaattgctctgttgtgtgtggtgcttaaaacaggtttaatctgctattattaatagttccatgaagaatatgattgcctatccccatcccactttcaaccactgtggccaacatacgggaactcaggcaactaaaataattacagaccacaagctgtaacaataaaccacaaaaggactaatcatatcctttcttggaatttacttatttcaaatagtttgttactttttttttcatgaagagctccatattggaccacaattgtgatgagaagatctaacttggatttcagctgcagaaattatgctatttactttcttattacaggcactaaattgctgtttggattattattatttttttcctttctctagatagttcaacaaatagattttacggtctctttatgggacaaagcagagtatgatttcgaaaagtataaagactaaataactagataattgcctagagttgaagtggtgtattcaggaacttcactgggaggaactaaaaataatttaaaaataggagaaagtgtcattggcccatttatgcaaagccaatgcaaagaaaagctgaacacttgacttctgagaaattaaagacaaactgtggtgccaagttacagcaattcccttggcctaatttttggtaaatttaattttatcctttctcaatgttgtggaatctataatgtatattttattggtcatattatatgcatgtctcatgcaggtttccttcagaacttcttgaagatcaatagggaatatattaaaaatgaaaatagaaattaggttgaatattggcctacctacaatggttgaaaaatcactttagaaaaaagtggttttgcttatttccttgttgacctatttgaatgctttttatttaaaaaaaaaaaaaaaggtcctcagcatgaaggatttggtaggtgatgttttatctcactgtaaacatttctttttgctaatcaaggatctttgaatgacagaagggattttaaggaagacaacaagttagtcttctggagtaacattatctgctctagtgaactggtcctttggagttcggtggttttaaaggcatgctttcttttattatttggagattatattgtttaaagttttctgcatggtgaatagaggttgctaggggaacataaaactctacacagagacagaactatgactaggtccaggctctgtcaccaaatagcttgtgatgctgagtcagtctcacaaatgtgcagcctgttgtttcctcttccacaaaatgataatatttctcttcatgtggctttggcagtgatatgacctattacatgtgaaggcattttatgataacgtgcggtgcacattagacatcaaactttgttaacatattaataatatacctcatttggtgacattgttctttttcctttataatttttcaatgataattattaaaatctttgtcatcaacttagtgaaaccccgtctctactaaaaatacaaaaatcagctgggtgtggtggcacatgcctgtagtcccagctactcaggaggctgaggcaggagaatcacttaaacccgggaggcggagattgcagtgcgccgacattgtgccactgcactccagcctgggcaacagagtgagaccccatctcaataataataataataataatactttaaaaaaatctttacgggtcatatgtgccccctcccagttcaccaactttgccttctcactggatggttctcataacttaactctatttccacctacttttctaacacggtatttcataccatacaaattggtcctttacgcaaaataatttatatgttaatgacttggtcagatgggctcaatattaactttttcctcgaaggtgctagtttgttatcccacacacagtgcagttaatacactcataaatgtccttcaaaaatgtttctaagggccctgcagactgaattttagactccgtgctcatttttacttcagtaatttcattagtagtgtttattttataaatagtttgtaaagtgtttgaaggcagaaacatttttaaaatgtttatatatttttgttccaaagtattttgcagagaaacaaatccacagaagcacccctaaactgggagtgtggtgaagtggggaagagcccagcccagggctgcagatctcgggatccaagaatacatagcaggtagctcaagagggaatttagagtctaggcctgcatagaattcacctgaaaaggtggaacagagaccaggactgaaaccaggaccaaaacaaggaccaaacaaaccagatattccagagaagagtaagtggtttctattggtaagagttgggattagcagaaatttcctgaaacccagatgtagtcacagaagccctagagatcccatggccctgcctaagtgaaattagggagagggctcagtggggtgtcttgaatacatttacttgttcaggtgtcgaataatgcctattgagaagcaactatgtgccaggaaaagtacagggtactgggtatatgtgggtaagccagacagcagcaactctgccctcatttacctcccatctcagaaaacaataaacaaattcattaattattagagataatgataaatgctaagtaaggaacaaactggacacagcaggggtttcacctacatggagctgtgattaggggagatgatgtttaagatgacattggaagcatgagaaggaaccaaaaggtcctcagaccaggagaggccaaaagctcttctccatgagtgatttaaagtaaatgtacataaagagtagccagtggaggagatggttgttagcaccgtgatggaaaggtattgggaaatgctggaaaagcatggcataagggcaagaagggaaggtcacccaaaggcaaggttcttgtgggcttcccaaacctcctctgcttctctgcaggtgccagaatttggttatttctctgggaagaacttgtgtcatgaaattgaaagaagcccaagagagttgcgccatagagaatgaggagtgtttgtcagatatatagttgtcatttactgaatattgtggttctcatcttagtttactcccaagaaaatacctggaggctttcaggtgcttctctcttacgaggcctggtactaatgttttcattcaattctttgagcttccctagattcttttaggaacttcttttttttctcctgttagatcaagattctgttgcttaccatcaaagagcccaagctaatacagtcacctctctgtccttatcttgcttgtctgcttagcattcaatgcctgttttttgaaggactattgtctttgggtttatgtgataccacatcctcctggttttctttccatctctctggttgcttcttttcagtgtcctttgctatctcttccagctttactgatcctctaaatgctagagtccctcctgaccaggactaaatccttttgtctcttttaagtcattcttagtggtcaaaaaggtatgcacttaggtgctagggtaccttggttcaattcccagccttgccacttcctagctgtgacctcggagaggtcacttaacaattccttgcccatttcttttattattattattattttaaaaaaacctatttcgtagggctgctaagagaataaagagggttaatcatacctaaagtattttgggcagagctggttcattatatgcattcaatgcatgttatttttcttacaattgttagtaatcatcaattcccatggccttaaatgttacatatatgctggtgacccttaaatatgtattttcagccccaaacacccctcttagctctataaaattatgtatccaaccactagaatttatcaaactttagaagactaaattcaaattttgattactaattcttaacaccccccaatctcactcaacaatttccccccagttttctgcatcttagtaaatggtaagaatacctgcctagttgtttaagtcagaaaacttggaatcatctatattgttgctctttccctcctagccacattcaacctatttgtcaaattctgtcatttttatttataaaatatagattaaatactttcacttctttgtatctcaacaattaaaatttctaatccaatgtaccatcataacttggctagtttactgcaatatcttctttacccattctttatttttcctccatgaccaaatccattatttgccaaatagagttttgttttacaaacataaatttgtgtcattctcctacttaatcctttaatgattttgccctgtgcaatgagtcaaatccagtctgcaagactctgcttgacttgctgtatgtctacctggctggtctcatcttatatcaccttctccctcaatcatggtgatttggtcacatcaacctccatcagtttcttaaatccaataaaccctttcctgccttagggcttttgcgcttgctgtgtcttcaaccaggaataactttttccttgcttctttcattactggttttctcctgaggtctgccattaaaaaaccctcaacttcagaaaggcctgctacatcactcagatttctccagagaagagagatgattggatctatgtctatctatcatctatccatctgtggatttattttaaagaattggctaatgtgattatggggaatggcaagtccaaaatctgtagggcaggtgagcaggctggaaactcaggcaggatttcaacattatagtcaaggcagaatttctgcttctctgggaaacctcagtttttgctcttaaggccttcaactgattgagtgagccccactcacattatcaagggtaatctgatctacttaaagtcaactgattatagatgttaatcacatctacaaaatatcttcacagtaaaatatagattagtatttgaccaaacaactgggcaccctagtatagcttagttgacatataaaacttatcatcatactttccttaggtctcctgcatccacaggagtctctttcatagagttctctctttttttttttccattggatgtaccataatttacccttaagtaattctttgcttacttattaatttccccttcctccaccacactctaatgtctatcaggtgagaacgattcttttttgcatcaatatatatccaatactagcaaagtccttgggatatattaagcattcagtaagtagttggtgctcgatgcttaatatgtgtttgtgaaaacaattaacaaccacagggaacttgagatgaaaagttttgacccaatcttctaaaatttttatgggagttagaatatcagatgttaagcataatttactaaaatgtgaatagacaagaaaataactgattatttctcattttcttttgacacattctcctcccttgtattttcctgaaattaaattagtcaacacagatttaagaggacttagagtctcacacactcagcccaaatatagcattgaaaagacttccaaagctttggcaacatattttattttaataaagattcaaatgcctgcaggatcactggaataattgccagttacacttctattaatgaacacatttaaatggggattgtgaaaagcagaaaatgatctgattttatggagtacgtttactgccagcaatgtacagtgatgaatggtgccctagaatttaattttagttttagccacaaaacagccaaaattgcacagcagcctctttaacgaatatgtactgaacttgaaaaattatttattgagttctcagtgatatatatatatataaattatttattgagttgtcagtgctatatatatatatatatatatatatttttttttccttggagatggagtctcgctctgtcacccaggctggagtacagcagtgcaatcttgctcactgcaacctctgcctcccaggttcaagcaattctcatgcctcagcctcccgagtagctgggactacaggcatacatcactatgcccagcaaatttttttttttttgtatttttagtagagatggggttttgccatggtggccaggttggtcttgaacatgtgacctcaggtgatccacccatctcagcttctcaaagtgctggtaatacaggcatgagacaccacgcccggcctcagtgatatatttttgtgaaccaattagttacttcaaaaaataaagaagagtaatgctgttaaagttgatccacatagcagtcttattaccacccttgcatgggctctgtgctgtgaagactaggttctatgtgcaacaagttctattaacaagcctctttggatgaagctgcttttgaacttgatatgcattcagttctgatgtacagtgctaaaggaagtagaaaatctcaaagggttcataagacagagtcttagtactatttctaaatgctggttcttcaagtggtatttgagtttgaagtacatcagttcacactgctcccagactaaaacaaaaaaatgtcttagaaggattagctgaatctaaggaaactttttaggaatattaaccagaaaaattcaggagaagcaagttttgttgactttatcagaatgctgtttgttcccctaaatccaacttctccttttgcatttatatactgatatttagccagaaactacatttcccatcttcccctgtagctagatgatccctgtgactaagtttgagcccttaatgtgaataaaagtgatgtagagactcttcatgttatctttaaatccagactcacttgcccctggactatgactacctcactttccctcaggatctgaacatgacactgacccagtttataggatatagatggtagcaagggatagcaggacaatgtgttggaaggaacctgggtcgctgaatgacatcctgctagagcagagctgccacatcagcctggaccaaaccaactatgacttgaaagaaaatgggagctttcttataggattgttgcagatgaatcaatacagaaaatcttgaagtctttagaaagacttgtaatgaatttttatattatttagaggttacttttacataagttgtttttaaaaactacctacattttaatgttatgtctttaagacatcaaaaattatgctatctcttttgatttttgcaaaatcccagtgagggaatcattatgagaaagattatgttagcttctggaggaactcaagggacagaataaaagtaaccacaataaaggcactattttcagatttgtcctctgacaactctttgtagggctaagaacaaatctgtgttttctaactttttttagggaggtgactctcaaatctgtatgtgtgaatatatgtataatattaccattgcgataaaacttataaagtgatgtctaacaagtaagtcattagacatccagtgcttagcatgtacccaaattcaactatattccaatttgaataaagcatatatacatctatagagatatagatctatagatatagatatacatagttttcaaaaagcaaatatctacctatagacatctatctctatatatctatacacatagatataagaatatattagattcccctattttagattattcttcaaaaagcaagtagatatctatattgtataccatgtatatatctatattatatatatatatatagataggttatttttcaaaagcaaatttatatatatatatgtacataatgtgaatcaaagtttgagagggggaaaaagaaactttaagaaagaacttctagattatacaacacaattcagagtactggcatgataataatggtgctaatagtgataatgataatagcaataacaataatagcagctacattttgagtgttgtcatgagacagggtctgtgctttttgctttacattcattgtctttgcaaagcatctatgagatgttattcttcaattttgcaggtgacatatgaaacccagggagtatcttgcccaagggtaaccagaaccagaatctaattacattataaattttacctcaacatatatccatttttgcacagaaaagagttagcataacaggtgtgagatcactgtccttagaaaggcctgcttgcaaggctagccacttggatgttgggaaagtgtctaccattctttgaagcaaatggctcactgtgcttaaactgtgcaaacaatatggtttatgttgaacatctgctttgcttcttggagtctggaatttgggtacatactaagtactgaacgtctaatggcttccttgctagacaacattttataaatgctatcacaatgactcattgctgggagaattaagcacttcctgtgagacttcactcagaaagaactcttggaagcttgcctcaggtttcctccaaacattaccccatgtgccttttccctttgcagattttgctttgcattcttttgttgtaataaatcataaatgtgtgattgtatattgggtcttgtacatcccctagcaaatcttcaaaactagagacagtcttgggaacccctaacatatctatcttccatgtcattctctcatttggagaaaataaaattttattttctacctgagtacataggaagacgtatttctcagcctctcttgaaatcaagttggaccatatgactgagctctgatgggtggaatgtctgttagtccaaaataggcccatcaaatgccccacaccatccttctgctctcaactgaggaccagatgcagatgacccagtggaggaagctggcaccataggcaatagtggaaccacgagatggaaggagtgtcctcaataaatgagttgaacagaagtcccatcctgtccccaacggagtcacataggattaggaaatgaaagagaaacaaacatttttttgtcttaaaccactgagttactggagctgtgtgttacagcattgatccttctctgtctaatacatatggtgacgtgctggataccaacacccccatctccttccgctcaactttgaaatatgttgcaagagtgaaagggatttttaagccatagagatcccattactcatttgatagaataatatttgatgggcaaacacaggacacgaataatctaccagatggcgactcttgcaagggaatcaaaggaagttcttcattaccatttgagattgctcttaacatttttgagtagtacttgataaaacaaatagaaggtgttaaactactgggtgtagttcttttactaaaggagccatgctctttcactccccctattattagattatttttcaaaaaagcaaattaacagcacttcaattttactcagtagatgtggaaagaactaaaaagaagaaagtgagagaagataaaaattttattgggctggcctccaatctttttgtttggggtcattcatttgttcacatatatttattgattacctgtcatatactagacacagcctgaagggctgagaattttgtagtaaagaaggtgcagcacctgctgtcaggaagcttaaagaataggggaggagtccacaagcaaagaggaaacccaaaataagcactatgatgggagcacatagcagagtctccaaacctactttaggagatatcagagaaagcttttccacagacaagtctttcaaccccaaaactctcaagatagctgtgagtcctcctcagtttccctccccttttaatccaaaacatcacgacgtccactcagctcaacctccaccacatatccaagcccatcatttctctccttctctacttgctactaccctggtctatgccacatctcctttccgtcttaatctcttggaccagatttctagagggtccccaattttactctgatgtcttacactccattttgcttagagtagccctccagggccatcttaaaaaaaaaaaatcaatgctttgtttgtatctgaacttttaaaaactggtagttccccactatccttagaataaaatacaaatgacgttccaggttccagccactcttgctcactcttgcctcatgattttgggttgttctttatgcctagaaagtccttttttctaccttcccatggccgtgcccttcttgacattgcagatacaatgcaatgccacttccctttctctagccgccccatcgaaagaagctccctgctctagttctttgtaacaaatgtcatcctccttctactgccactagatattttcttatttaactatgtgtttgctttttgcccctcttttcactatcttcccccaatggaatacaaactctaaagaaaaattacctgtctttttttgtcagtgtatcctaaataccttttacagtgatgagcctgaactcagcactcagagaataagccatgaaaaaatatattgaaaggaagtctaagtatggatgtggagaaggtgtagctgttgtcctgatgaagaagggaattgtgggaagcagcatttctcgcaggagaaaaagtccaggtcaaggcccttcagaggggtgcacttcagctgcaggcagttccttctggctggagcagagtaaatagggatgagtgaggggtgagacgcgaaaagtcagcagaagatggttggtcaaggcctggctgatcgtgaactagttgggtcactgcagtatagacagcatctaacccaatatctgacttatagtagatgttcaagaaatatttgttggatgagcatgtaaggcaattgagtctctcttctaatggcaaaaaaaaaaaaaaaaaaaaaaaaaaaaagccagcaattggttttaagtaggaactgactggtttctatttgttctttagaaagaccttttcagctgcacagtggagaatggttcagaggaagacaggactgtaggcaaggagtctgggtcattgcagacatgcagatgagaggtgacagtgacagcagcgtgtgagaggcagggcagtggagagggaaaggcagaggcagatttgagagatacaaagactggagaattggctgagcttggagattaattagaaacaagaggttctgagggaagagcccagaaagacaactggatttacattttttttttttttttgagacacgatcttactgtcacccaggctggagtgcagaggcacaatcttggctcactgcaacctccacctcccaggctcaagggattcttgtgcctcagcctcccaagtagctgggatttcaggtggacaccaccatgcctggctaatttttgtatttttagtagatatggggtttcgccatgttggccaagctggtcttgaactccaggcctaaagtgatccagccgcctaggcttcccaaagtgctaggatttcaggaatgagccaccatgcccagcctggatttctaagtgactgcataaatgaaggtaacatttttgtcaaaataatctctccacacagatgtatgcacataaaatatacctatgagaataaaggagaaaactaacagtagttacctctagcaaggtgggatgagaagtttcctgtacctaggacacttcgatatttcaatttctaaacctctgtatgatttcaaatgtttagcatgacattttatgagtttaaaatttgaaagaaggccgggcatagtggctcatgcttgtaatcccagcactttgggaggtggaggcaggcggatcacctgaggtcaggatttctagaccagcctggccaacatggtgaaaccccgtctctaccaaaagtagaaaaattagctgggtgtggtagtgcacgcctgtaatcccagctactcaggaggctgaggcagaagagtcccttgaacccaggaggtggagttttcagtgagtggagatcgcgccactgcattccagcctgggtgacagagcgagactccgtctcaagaaaacaaaacaaaacaaaacaaaaaattgaaagaaacaaataaatcaagaagcatctaaatgccacagaatatattagattgatgcaaaagtaattgtgatttttgccattgaaagtaatggcataaaaacacaatttcgttcacaccaacataatgcataacataaactaatgcttaacatatttcaagatgacattactgagtcattatgaatttttaattacattatgaagtttagttacttttgtacatagaagaataaggaaagaactgaagggctctgatatcttttgacagcactcttaaagatattaagtaaaacatttctcatttattttcttatctacatggatattaatatcctaaatttttaaaggatagtttcatgtccagagaatctaagccattgttcaagctcagaaatggcagcggtaaggtttgaaccctggacagcgcttgcactatgtcagtctatggaagtcaaaagggaggtcgtgttaactgcataggcttataggcaatcttcccttcagaaagcccttctggttggaaatctgacagacagttctgctagggcaaaggaaatagcattttaactctgttcttaccttaattctaaagtacatgaataacactttgctcttaaggaaggccttttatctgagtctttcaaacactgaacaaaaccaattattacccaccctccttcatggttcaaagagaagattttaatccctaatttgctgacagagagacagaagccggcaggaatgaagtgatttactgagggtaacacagtctatgaaagcgttcaagaataaccctgagggcttgtgacaaaagagcaattgccttatgcaattagcagtgaattcctctgtcctaatcactgcatcttactgtttcccatgcaaagtttaagggaactaaacttctcctctttcctttcccaccataaatcggacgtagtgctttttatgtaaatgtactttgcaaaaatgtagatccctataattttaccttccatctgtttcatctgtttttaaagatcttactgcagaatttcccaaacactttgaatggggtggaaaagccccatacaagaactcagatgtcctgctggttcctttggctacaacatcaaaactcttgcagaaatgaaacaaaaaaaaagtatgcttctgttcttcatgaaattgcccaaggagggtgtctggataataagccaaacatggagggtggggattaactgcatttgagatgtgactgcagagcacattaagctgctttgctctacaggtgttgctgcttcctcacaagctccactgtgatggatacaacctatgtgacccccagtgagtcacacctttttaaatctcctcatcttgagtgctgagatgtgcagtgtaaggtcccctgagcaggctgcaccatggtcaagccatcatgacccctgtgacccacatgtacacatccagaagtctcaaattctgggagccagaaagtctgggacaacaggaaaaccactaaagaagaaaaatggctagtacctgtcttagctgattaggtaaccctgcgacattctaccattctagcatgctctaccctaactgatcaatcaacctagtgacactgtgctctatgacccctcccaccttgtgataatgcaccttgcaaccttcttcccctgcccacaataaatggcccctaactgtaactttccactgcttaccctaatctatgaaattagctccaatcccaccaccctctgctgactccctttttggactcagcccgctcacatccaggtgaatagacagtcttgttgctcacacttagcctgttcaggttgtctcttcaattagatgcgcacataacacagaggtgatgggatgagatgccacacccatgactgtactacccattagaggactagagagaccctccgttgttggctttgaagaatccagctgccatattacaagggagcttgcaagaggaccaggtggaaacggactgcaagtagcctctaggggctgcgtggccctacattgacagccagcaagaggggaatttcatatgtgcaaccacaaagaattgaattctgccaacaaccacaggagcttagaaaaggatccacgatccagaaagaaatgcagcccaatcatgattctaactgtggcctcatgaaactccaaccagagcacttagctatgtcatttctgaactcctgatccttgggacagtatattatgaatgaatgttttctaaatccatttagtatttggcaaattgttacacggcaacagaaaatgaatgtaaacatctttctattttagataaaaaaagatagtaacataacatttaatgtcaaaaggacattagcaggtattaaagtgatgccttaatgatatatttgattttaatggataattttacctattataatccagagcaaagaaagaaaaggaagcaggggaagattccatagaagaaggaaccagctgtctgaagcatagaggtctaactatttgcaactcatcctgtgccttaaaaatgggaagactaggttatatattattaattaatgacagaaaaagccaaagcagcattggcatcactatattaaaacttagtgccccactatatcatttacaaccacctaaaattgaactgaagctataactggtttcgaaagagtgcagcaaagcaagattatgaaacatatatattgatatttgtgtgaccttttgaccattggttctcaaatgaggctttctgttcactgtctgttataatgtaaaatatttttaatagattaaggacttcagattaaaaaaaagaagaattcctaaacatcatcccagttaactgaataaaaatcctcaaaaataagacctcttacctctctccaacccctacacacacatacgcgcacacacaacacacacacaccaaagacttcatgcgattccaatgtagctagcctagtcattggtatttgtcatgatagagctcatcactaataggtcatttctttttgtgctagaagcaccttgtatatgttatatatctagttcaatggttctcaatcttgcctacacaatataattacttgaagagctttataaatcctaatgctgaagctttttcccagagcaattacatcagaatcaccaagcatagtagccactatttttaatttgtaaagctccccagatggttgcaacgtgcatttaattttgagactgctgatctgtagataatagtttgcattttctgcatccttcctaatatataattatgtagtccaaaacccaaacactgcctgggaagtatgtaggccaaccacgactgtcccactttgatggaacatacaactgaggttgaccatttggggccatactataataactcctttttattgaacttcatgtttattatatttatttctttaaaaaagtgcaatctagttatcattatcccagtttatagacaaagacacatcgtctcctgagtcagagggaactgcccaaatgagtaacatgacctgaggctgagtgacaccgaagcttatgataactgcacaaaaccagtgattctcaaagtgtgggctccagaccagcagcatcagcatcaccttggaacttgtaaaaaagaaaatgcaaattctatgacccaatcccacctctactaagtcataatctttcaagatggggcccaggaatctgtgtcttgacaagcccttcaggtgattctgaggctccttataggtggacagtgtactgtattctgtctctatcagctgctcacttttgagactcagaatctggcaagagacctaaaaatgtgtgggagcctcagtgagtaagcctgtgtgagggaggagatatttctctcactatcttcccttcctctcatttccaatctatattaacaatctatgttgaaaatgctaggggatgtatcagagataccatatgggaaaaaattggtggagttatgctggtcatatttacttgcaggggtgcctggctatgttgagctactttcacacaagtgtgaccattttaatatgttgacgaatggtttatcctttgaatcacagtatggagagttttaatagtttcattaaaaatgaatatcccaactgtttccagggaaatgagtttgtgatcttaagggctttgaggtaattggtgtttagggaaccaaggcagttggtttgctttcttggatggaagctgcttcagcttactaccatgctgtaaaacccaagtgctgctgacctgcttagtgtatttcggctatgcttagggttcatttattagaattgtacatttgactagggggaaataaaaattaaaaggccacttgtgtttgatttatgagagatgtcgattaatattttctgagcaaactgtgaagtcctttcttttaaagaagtatataaaataggcctttggcatattcaggtctgatggaaatttgtctcatggggcagggtgagatgggagaaagagaaatcaataaagatagagaagagaaaaaaatagaggaagaggaggatggggaagagctgaaaggagacaataattcacaaggggaagagacagaagaggtgaaaaaaaggaaagcaaggaggagtgaagaaataagaggtggggtcagaaggattaaaaaaggggaaagaaaagagtttgggaaaatgggggaaggagagaaaaggaagaagagaaggacatatgggcaacaaaaaaaaacataaaataaaaaaaaataaagcaatgaatgcagactttggagcctagcaatttattgtgaagtgccacttgtattagacatgctgcagagatgctggctccaaagattaatgatggcagtaatcatgattccaatttatagcaaatgcaatgaaaggcagccagaccccaaacagagaaaccctacggggatggcattggaataataacatagcagcagtcgaggaatacagggatgctgagagattggattcagttctcctgtgttcaacaaacattctgtatctgatgtacaatccaatgttaaaaagaaaaaaaaagtctgcttattactagatctctgaattatagcaaagaagtttaggtgttcacatgaacacatttgaagttttattctgtgattcacctcctctgagcactgacttttggcccagattggtcttttacacctcctttcctttctgtccttgctgctcagtgtttttctgctgccagtggtcaataccactgtttcattgcaaatacctgctgtctctgaagcctggaaccactgcagaataggcataactactcatcctctttcctggttgtcaaaacccttttccctttatgcatgtttatttgtatgtattgtcttgatatattacctatcagattcctttaatcagtggtctgtgtgtgtggtgagcactcatctccattataatctcctctgcccccacctattgccacgaagtcctaggtctttgcagatgatcaaattttggagaagaaacaaatttactctgcataatagagggagaaaaacttagaaagcccagggcaaggagaaggggctgaggagcagaaatgggagaaagacagactccattcattcagacagatggtggaaacttgtgtgcaatgcgcatgcagaaaccctataaaaatattctgcagtgtcaactaccggtatgaattctctgagtaaattgctgttgtggattccaaagaagaggtagagattcatatctagtctgcataaggttggacaaaggcagcagttgtggtggtcagatgtgaagaggatggcattagaagaaatccttggacatcacagacttctacacgcactggaactggggttcttaggggctgggtttcaaaaggatcaaagcaatttaatttggatctccaggggtgcctgtagctactttggtttccatatgtataagaacaaactatatgttgggatgtgtatgctatttgatacataaacatttgatgcctttaaggatgaactgttttcagatagattcatgacagcaagttttctctccctattcagaccataagctccttaaggatagaagtgtatcttctctggcttttgaataacctgcagcatctagtttaacccttagcacatacaaagtatttggtaagagactgtgtctcatagtcagcctggatccactcactttctctcaccccaccctctggggttttctgggctctcattcccttttgaagatggttcacccaggagggagggtcatctgcacacctggattgcagagaaccaggtacagtgatgacctacagacacctgtggtttacagacattggcagcatggttttttaaactataaaagttacagtaattatcctccaattccaggaatggaatcccttgataggcctcaatctacattcaagattcaagtcaagcaccagcctgtatttaaaaactaaggaaacaatggaagtttaatgaaattatgtcattatagttgatgaagagaaaatatttcaaccaagaactgaattgaataaaactttctcagaaactctttgtttaatgggcaatcacagtatgccagcatgggtgtgccacagagaatcaaagtccacagatactgattatattcctatctgggaaggatcagtatgaaatatacatatgatggggctctcatagaatgggatattttcccccttttcctctcatttctcaatgctcctctgggaattgtgtgaaggtaaagtcaaaaagaaagttcttacattcttaaatcctctgtaaaggatctgaagctctttcttggtaaatttgctctgggcttccagaagctcaagggcttcaggccgatgcctgacggtggccatctccagttcatcttccacgctgtctgtggaggaaaacaagaaagagtcttaggaccagccactgctcaccgatgcttacacagagcaacaaaggaaaacggaagaacatgtctgctaatgtctgtgactgtccacagaggaaggaccctcacaatgcctataaggcctttacatttcccagtttaagcgtattaagctaaaacacttgtatatgatttttttgcatattcttgtcattaatgtagatattacaaccctagcattgttttaagacaacaaaaaagagcacaggaatttatttcagataatcagtggattatatgattacgtcaaacaaaaagtttaagtagcaatatatattactctataaatctaacagtaacatatatttcttttttccccaacgtttaagttcagaggtacatgtgcaggatgtgcaggtttgttacatgggtaaacatgtgccatggtggtttgctgcacagatcatcccatcgcccaggtatgaagcccagcatccattagctgttcttcctgatcctctccctcccccaacaggtgcccagcatgtgttgttccctggcagtgtccatgtgttctcatcaatcagctcccacttacaagtgagaacatgcagtgtttggttttctgttcctgcattagtttgctgtagagaatggcttccaactccatctatgtgcctgcaaataaaatgatctctgtcctttttatggctgcatagtattccatggtgtatatgtaccacattttctttatccagtctatcattggtgggcggttaggttgattctgtgactttcctattgtgaatagtgctgcaatgaacatatgcaggcatgtatctttataatagaatgaattatattcctttgggtatatacccggtaatgagattgctgggtcaaatggtatttctgcctctaggtctttgaggaatcaccacactaccttccacaatggttgaactaattcacactcccaccaacagtgtaaaagtttccctttttctctacaacctcaccagcatctctagcatttttaaggtatagttagaaaaacatagaagatcacaaatagtccaacctggaatttgtttctatataacaaccactagttataaacaatggaattgtcatttaataataatcagttttgtgccctatgtaaaatgcaactacaagatagcctctgataatgttcactaaggattccaatgaaatcagatattttgcacagctacttgggaggcggaggtgggaggactgcttgagcccaggaggctgaggctgcagtgagcagtgatggcaccactgcagtccagtttgggtgacagcatgagaccctgtctcaaacaaacaatcaaacaaacaaaaaaaatagaaccttagactctcagaatggaaggacatctgaagaaagatataaggagatagagaaagaaggaaacctccctaattcattctatgaagcatcaccctaataacaaaaccagcaaatgacataaccaaaagagaacactacagactgatatccttgatgaacatagatgttaaaatccttaacaaaatactcactagctgaatccaacaacatatcaaaaagataatccaccatgatcaagtgggtttcaaaccaggaatgcagggatggtttaacatacgcaagtcaataaatgtgatataccacataaacagaattaaaaacaaaaatcacacgatcatctcagtagatgctgaaaaccattcaacaaaatccaacattcctttatgattaaaactctcagcaaaattggcatacaaggcacataccttaatgtaataaaagccatctatgacacacccacagccaacataatattgagtggggaaaagttgaaagcattccctctgagaatggaaacaagataaggatgcccactctcaccactcctcttcaacatagtattagaaatcctagccagagcaatcagacaagagaaagaaaacaagggcatccaaattggtaaagaggaagtcaaactgtcattgtttgttgatgacatgattgtttaccttgaaaaccctaaggacttctccagaaagctcctagaactgataaaagaattcagtgaagtttctggacagaaaattaatgtacaaaaatcagtagctcttctatacactaacagtgaccaaacagagaatcaaatcaagaactcaacccctttacaatagctgcaaaaatataaaatacttaggaatatacctaacaaaggagtcaaaagacctctacaaggaaaactacaaaacactgttgaaagaaaccataagtgacacaaacaaatggaaacacatcccatgctgggtagaatcatggatgggtagaatcaatattgtgaaaatgaccatactgccaaaagcaatctacaaattcaacataatccccacagaataccatgattattcttcacagaattagagaaaacaattctaaaattcatgtggaaccaaaaaagagcccgcatggcctcatagaaaaagcaagactaagcaaaaagaacaaatctggaggcatcatactacctgatttcaaattatactataaagccatagtcaccaaaacagcgtggtactggtatgaaaattggcacatagaccagtggaacagaatagataatttggaaataaacccaaatacttacagccaactgatctttgacaaagcaaacaaaaacacagagtgggggaaaggacacccttttcaacaaatggtgctgggataattggctagcctcatgtaggagaatgaaactgggtcctcttctctcaccttatacaaaaatcaactcaagatggattaaggacttaaatctaagaccagatactgtaaaaattctagaagataacattggaaaaacccttttagacactggcttaggcaaggatctcatgaccaagaacccaaaagcaaaagcaaaagcaataaaaacaaagataaatagctgggacctcattaaactaaagagcttttgcatggcaaaaggaacagtcagcagagtaaacagacaacccacagagtgggagaaaatcttcataatctatacatctgacaaaggattaatatccagaaagtacaacgaactcaaatgagtaagaaaaaaaccaacaatcccatcaaaaagtaagctaaagacatgaatggacaattctcaaaagaagatatacaaatggctaacacacatgaaaaaatgctcaacatcactaatgatcagggaaatgcaaatcaaaaccacaatgcaatactgccttactcctccaacaatggccataatcaaaaaatcaaaaaacagatgttggtgtggatgcggtgaacagggaacacttctacattccttgtgggaatgtcaactagtacagccattatggaaaacaatgtggagattccttaaagaactaaaagtagaactaccatttgatctagcaatcctgctactgagcatccgcccaaaggaaaagaagtcattattcaaaaaagatacttgcacatgcacgtttacagcggcacaattcacaattgcaaaatcgtggaaccaacccaaatgcccatcaatcaatgagtggataaagagactgtgatatatttatataatggaatactactcagccacaaaaaggaaagaattaatggcatttggagtgacctgaatgagattggagactattattctaagtgatgtaactcaagaatggaaaaccaaacctcgtgtgttctcactgatttgtgtgagctaagctatgagaacgcaaaggcataagaatgatacaatggactctggggacttgcggggaagagtgggagacaggagagggataaaagactacaaatattgtgcagtgtatacgtgggtgatgggtacatcaaaatctcacaaatcaccactgaagaacttactcatgtaaccaaataccacctgtaccccaataatttatgaggaaaaaaagaattgaaggacatctgttcattttacaagtaaagtgaaaaaagaaatcagatattttgccttgggctacaaaataaaatgttcatattaggtgctgacaagggtaaagtaaccagcagccagttggtttcatgggtacatactggatggttgggggcctagaggatattctatttaggtccattttgtagtcaatagagtcaataggtatagagaagctttaaaatattgtactttgctttgtgaattatgtttacgctataatttctcaaagatgttttatgcaaaaaggaattttgtgcccatagatgtttggaaaatgctgtgaactttaatgtagttttgtcacaaaatattaaattatataggtttgcgaagacctgtaacaaggagtcttgtttaactttgcgtaacccaactgaccccaaaggtatttgtccatagaacctttcctggcccaagtaacatctggtaatatctgcacatttgccctagggtcatgtaagcacaagtctggaggatttggaaatatattagggttcaggtgcttgtgtctcaaatatcatccttcagtccagctcctttgaagtggggtcagatagtggcctataggaattctctctgttgtgtaaaccaatccacacctcagatgaggaacttagcaggaataaaaacatccaggctcagtatgaagccttggcttcccctttctatcctttcttcttgactacagattggagactcagagagaagggtctaaggataacagtcagctcctctcatcccagagccactaggaccccaatcccttgtcccatgggtcagttggaaatgtagtcctttttgccaaagtcgagccatttttgacactaatattgctgcctcttgctaacatctgttcctccttactactctgcctcactgagagcattgaggggccaaagctctcacttggcaaggaagagaaggtgagtggcaccctaatcttagcatatcttaattattgccctcaaggagtttacaaaaaaaaaattggtgatgaaacaaacacttggagtggctatatttgtgaaaatgagtaataggagatgaaaacaaacatttgctttgtactttttatattataataacttatctggaaagaatgaaatggaaaagcttcagaatagtgacggatgaataaaaataatagaaaaggacatggaaagatgagaaggctgacaaggataaaattgatgggataaaattgagctgacaaggataaaattgatgggaaagtaagtagttgtgctcctaaagtatgtgggaagagctcaaagtagctggaaaaaggcacctaggcattaacaaattgatctgggctttatggggaaaatcaaaaaagccaaaatccttcaattttctccttcattcatttgaacaaatgggttgattctattcaatgggtcctgagatagaaaagatgatggaaaatgttgcttttagactgctgttgatccaatgacttcaactatgttgtattattgtatttgccaatgcaggagtaaatagcatgcaatagacctcatgtaaatagataatatcgaatagaaagcctgtgctttcttgaacaatgtctgatgtaatcttcttttgaatcatttatagtgcaagttcttcaacctaaaatgttccactttccttttccacctgttaaaatgtatatatctttcatgatccaatttaaatataagtgtctcatttctgaagcctctctggattcccatactatgcaaaattggtgaccccctggtcatcgttcccacactctggttcttgtatagcatgtaaaacataacatcatgatctgctcatgtttgttttctccattgtgagttttttttgcagacaagatcaatatcttacatgtcttgtttatcctctgaacctaacaggaagtctgatactcctttgtcacttaagaataatctggtaaacaaaggatattcctgctcaactttctgatcctctccaatcccttgaatatttgctgccctatagggaaatatttttcagactgaaatttgtgggctgttggtggacctcaaatgtcttcttcagaatcactatgttctctatttattgtactgggaaatacagcaaaagtagaggggattttaattaaattttctgagcagtctttcagtcataacataaccttgtctagacctagtgaccctcacatgggacagaaccaaaacagcggattaaattctgggcctttgtatcgggcagcaatctgagctgtgctacaaatggagtttctttctctgcagatgcaaagtctgagacaaaagacacagggctggaggatcagtataattaagtgtgcgtgataggatgatcatcacatgcagtattaaaaaaaaaaaaaaaacgcccttgaagtgtctgcctgtgggctctcttgcttttccagctgtctggtaccttacttcttaatgactcctacctgccaaagggctgtttctatttctaggcgggtgacaggctctaaaaacataactgaaatcatcagcaatcaccagcatatgataagttaaaaaagcaacaccaccgaacccaatcaactctgattcttggaggcaaactatggggagcacggcatgatcccacgtaggactgcgaattctcattgtgactcagccaccttgtaagagcctgtattttgggtggttttaacccagtgcctaacatttattgagcccttgttgtatgccaggagatgggcaaggtgcttgattggcataatcctaatcctcacaataaccccagagtgaggtttaattgtttatttttcacatacatggagactgagtctcatggatgtgaagaaattcacaaccagaagtcaaatatgtgtttatatatacataaaaacataacatatatatctcctatgcatatatatgggtttccatatatatgcatagggacaagatttacacccaggtctttgatgccacagcttatgttcttcccacttcccactttgccacagtctcttttaataccagcagaaataatgatacaaataatgataacctctcctctcttattttgtcaaactcctcagaaaagttaactgtattcattagatccattttcttgctctctccttaatctactgcagtctgacttctggtcctatggtggactgaattgtgtccctcctcaaattcatatgttgaaggtctaaccctgtatttggaggtagggcctttaagaagatagttaagcataggccgggcgtggtggctcacacctgtaatcccagcactttgagaggccgacgtgggtggatcacctgaggtcagaattcgagaccagcctggccaacatggcaaaaccccccatctctactaaaaatacaaaaaattaggcgggtgttgtggtgggtgcctgtaatcccagctactcgggaggctgaggcagaagaattgcttgaacccaggaggcagaggttgcagtgagccgagatctcgctactgcactccagcttgggcaatgagagtgaaactccatctcaaaaaaaaaaaaaaaaaaaaaaaaaaaaaaagaggaagacacgaggaatgtgggcttacagaagaaaggccatgtgaagatggagtgggaagatggctcacagctggtaccttgaccttgaacttccagcctttagaattgtgagagaataaattcctgttgcttaagccacccagtctgtggcattgtgttatggcagccctagcaaactaatatatctacctatattcaaatgacacacaacactgataaaagcaggtcttgttatccacaaagtttgcacaatgagtgctgggcagtttgctagccaattatgtcatttaatcttcacaacatctttcaagagaaggattatcatccctattttataaatgagaaaattgaggcttggagagtctaagtaacttggccataacccaagcaactcttggccaaatggctacttagtaaacaagatgaagacaagtgtctccagcagcccaaagtccaggttactgagcactatgctgggaatgttaatagcaaccatcaccctatggagaacttttgctctaagcgtggttgtatattatcccattttaatacagacagaagttcagtgagatagctacattttacaagaagtcatgtagccctcattttacaaggagtaaattgggactcacatttcttaaataacttactcaaggtcatacagcttacaagtgacagggctgggatttaatccctggctttttaacaccaaagaccatgagcttagtcaatatgctactttaagagatggcaacaattaaattactttgttcaaaatcctaggggataaaagattttaaatcacaaactagctggctgctgagcctccaatgcctcaatttctttccagggaaaatatgccggggcaccttcaggagatcaccagaccagcagacaaagctgtgctgataagaaacacatggtagaataaggtacgaagtgatgggatctcagagctggaaggaacacaggaaactgtttgtttttctgcattttacccctgagaaatttagatttgggaaagatgaatgtttgtttgagacaaaaaccagaaccagatgggactctggcctctggagttatctccaggccatgcagacatatcatcactcaggtatcttgcagaagagccaattcaaatgcgcatttgcatcctgagataagcgaaatacaaatagtattttaattcatgtatcttctaacaaatttaattttaatcagacaacaaattcccaaacccagacaccattgagcttcctggctgtgtctttttgtcctttgttctttagatttcagtctctcagggctgagtttgtcctaagtctgactcaacagtcccctcaggccatgacacaattgggctagaaattggaattcaaatcatctaggaacaacagaatgcgttttaaaaatagtcatcgttctcctctttctcacaacttctcttaaaatacagtagaagcttggtacagctcaactcgtaattatgcaaatttgactctaagggcaaatcatgccatccagaacactactacggaacatcttgccttacgaacaaatatgagcgtgagtcctaccttttgacgacatgctttggaaacaagtcttctaatgcagaaaacaaataatattatgaagaataatgtcactttttgagaaagctgattcagaactcaggccatgtgtgcagagatgagtccttgcctataaagcatgaaacactgtgaggctgttgccttgttcttttatttaggtcctgccaaaatacgggaaggattatcttatttggcacactgaaggtgctccataagagaatgtgaaataaataactacttgaagcattccaagaatagtgagtgtatctacagcaggtcccatttcttttttttttcttctctttttttctttttttgagatggagtctcgctcttgttgcccaggttggagtgcagtggtgcaatcttgactcactgcaagctccgcctcccaggttaaagcgattctcctggctcagccttccaagtagctggaattacaggaacgccccaccacacctggctaatttttgtatttagtagagagggggtttcactgtgttgattaggctggtctcaaactcttaacctcaggtgatccatggacctcggcctcccgaagtgctgggattataagcgtgagtcaccgcacccagtcccatttctaaatacaacatgactcttctttaaaaataaatgtatccatttgtcattctaaaaagattataaatattgtaactttaaaattctatttgagctgaaattaatttgtctagacaaaaattcagcctgcttgacttatattgctttatctcattgataaaaataccctctgagccattactcctaatgtttacattttattaaattggccgaatagtgagttgatccatatggcaataacataatgaggatgatcactttctaatgatatcttatgtattattaaatatttagaagcttggtccagtggtggatattggaggaagatttccaatgctgaaagattcttgaccatagcattagatgctattcctgagaacttctaggataaggaggtgatgctattgtttgtttaatgttcaagtctgatacatcaggacaaagaaaaagctgcctggaggaagatttccaaagcgaattttcatggcactgatataatttatttccacccttcttttctactgcaaaaacttgtagagggatgacaacatactcaccattccattcctcggttccactgctcacaaagctcaaagagggtggcatgataatcagctgaggaaatagtttcttgggtggaggaatttgctgaagtctgcacagctgtgcagctgatgagtgtgggcacggggagccaggacctgccccaaacctgtctttccccttcctgttatatcatttgacctccctggatagagagtttaaactggggccaggccctgtaagcaactctttaaactttgacaattttaaatgctttattgcaagaatgcagaggtctgggaactcctttgacttttcctgtctttattactattcacccatccacctaccaagagttattttcaggtgcacatggagagtatagaagcaattaattccaagctgatcacacacaggctgcaagtagagagcagtcaatccatttgaaacactgtgggagtcctaggccttcccagaccaacccgagcaattggaatcctgatgttttagttagtttgacacgtatttctgcaaccctggccctgaatgtatgttagaaccaaaatacaaaaacaaacaccaaaaaatgaacaaaaccatttataattagtactttatcttacttaatatttgtatatcatattgaaaatgaacagttcttggaaaatggccatttagtttgaacatcttctgttacaggtacttgttggcaatgacattgcaatttccattctaggagaatgagaattgctttgcaatttcataattgaattcaatcacttatgaaatataacaacccagtggtgaacagctgaagctatttgccacagcacttatgaaatagattgtctctaccttatttacaaacataaataactcttcaacaagcttagattttaaaaaataatcacctaattggaatgcttattatcagcattaaccatattattactacagcatcatgaatggccccttatggtaggagttattattattattattattattattattattattattgagatggagtcttactctgtcacccaggctggagtgcaatagtgtggtctcagctcattgcaacctccacctcctgggttcaagcaattcttctgcctcagcctcccaagtagctgggactacaggcatgtgccaccacacctggctaatttttgtatgtttagtagagacggggtttcgctatgttggccaggctggtctcaaactcctgacctcatgatccacctgcctctgcctcccaaagtgctgggataacagacatcagccactgcacctggatgagttattattttttaggtggtagggtcttaattgatttttggtaaataagaaaaacaaaaattatactgccagtcattatgctcagacagaaaatctacaataggaatgctgagggggcagaggaaggaaacaagaaatttaattgaacttacacataaagacagaccaaaagagattgatatactagtcaggaaaggcaaaagctgagagggattatgagcaaagagaaaaattttaaaaagcaatggtatgtggagagagatgaagaaagcccagattagttcactaaattaaaaatgccctatcaaaggagtgcctcaaactttgatagattttctcttagttgtcctaaaaatcaataacaagacacacatatgtgtatgttcattacaacactattcacaatagcaaaggcatggaatcaacctaaatgcccatcagtggtagactggataaagaaaacatggtacatatacaccacggaatactatgcagccataaaaaagaacaagattatatcatttgcagaaacatggatggagctggaggccattatccttggcaaattaatccaggaacagacaaccaaataccgcacgttcttgcttataattgggagctaaaatataagaacacatggatacatagaagggaacaacagacactggggcctagtggaatgtggagggtgggaggaggaagaggattaggaaaaataactaatcagtactaggcttaatgtgactgtgcagtgggttcaccttacccactgcctagacagagccaatttatcaagacaggggaattgcaatggagaaaaaataattcatgcaaagccagctttgtgggagacccgagttttattgttactcaaatcagtctccctgagcatttagaggtaggagtttttaaggataatttggtgagtaggggctcaggaggtggggagtgctgattcgtcagtttggagatggaaccatagggggctcatagtgcggttttcttgttgtcttctgttcctgagtgggatctcagaaatggttgactcagattatcggtctaggtggtatcaactgattcatcaagtgcagggtctgcaaaatatctcaagccctgatcttaggtttacaatagtgatgtgatccccaggagcaatttggggaagttcagactcttgcagccagaggctgcctgacccctaaactataatttccaatcttgtggctaatttgttagtcctgtaaaggcagactggtccccaggcaagaagggagtcttttctagaaagggctattatcaatttgtttcagagtcaaaccatacactaaattctttcccaaggttagttcagcctacgcccaggaatgaacaaggacagcttaaaggctagaagcaagatggagatctctttcactgtcatgatttcctcagtgaaacttttgcaaaggaggtttcattaatacctgggtattttcgaccagacaaaataatctgtacaacaaacctctgtgacacgagtttacctaataacaaacctgcacatgcacccctgaacttagaagttaaaacgaaggaagaaaaagagcaaagaacaatcactaatatttatagcatttgttttgtgtaagctctctctttcatgagtgtatatgtatatatatacacacacacatacatatacatatatacatatgtataactagatatacgtacatgtaaatgtgtgtatgtatacatacatatgtatgtatacgcatgtatgtatacacatgtatgtatacgtatgtatgtatgtatatgcatgtatacgtatgtatgtatacatatccatgtatacacatgtatgtatacatatccatgtatgcatacacatgtatgtatacacatgtatgtatgcgtacatatgtatgtacacacatgcatgtatatatgcatatatatgtacacatatgtatgtatatatgcacacatatgtatgtacacatatgtatgcatatatgtacacatatgtatgcatatatacatacgtttatatgcatatgtatgtaaacatgtatgtataacatgtatatatgtatgttatacattttatatatacatgttatatatatataacatatatatacatacactcataaaatccccatcagcgtactataaatgctatattcttgttctgtagatgaagataccaacacagagagactaagtaacttgctcatggtcacaccataacagagtcagggaatggagtctgggaagtctggttccaggattcatgtaataactattcagctgttctgcctcccccagagcaggagagaggatgatgccccacttatctagaattcatgcacccaaataagaatcagaaaattagtagcaaaagggctctaagcagaaaatggaactctgtgagaattgaaaggggtattgagtccagccccttaactttgtaagttcatgtcacatacagagccttagctacagtggttgtaaatcaaaaaccattaggcatatcagtggcagaactgggcctaaatcttgatctttttcattcctactgcagcactttgtcagatgcctgcctcagtatcttttatggataagagtgtcttcatccttactgtacccacagttttagtaagcttccgattccacatcagaagcagatactgataatggagaaggagcatacactggaaggagtccatgagccacagttataatacctaattttcaccactggctcttcattatcatatctgagcaatgtgatattctgtgtataaatattgtcaccctgcttttatagataaagaaatcagggttggaagaaaggatgtaactgatgaaggacatagaaataggacgttatggagtcaggacttaaacccaagcttactgactctgaagactagaagtgactgcaggttgtctgagagtaatggagggaacataaagttgaaaaacatcataggcatattagagaaaagagtaatgacaaaagtcagtggctaacttattctttaagaataagttctaaccttattctttaagaaaatgttttattctgcttactttattttagaaggtaacagaaatgtgatacatttttaaatattattaattaaaattggcagcttattcatagtagccaaaatatggaaacaacttatgtccatcaataaacaaatggataaagaaactgatatatacaatggaatactattcaacattaaaaaagaagatcctactatttgtcacaacatgaatgaacctggaggaccttatgttaagtgaaataagcaaaacgcagagaaagaaaaatattgcatgatgtcatttacataaagaacctaaaaaaatgttgaatacacagagatagagaataaaacaatggttaaagtggggaggaactagggagatgtaggtcaaggtatagaaagtaacatataggatgaacaagtctagagatctaaattacaacatgaaaattatagttaatattgtatttgtgatctttgctaaaagaatagattttagatgctcttgctacatataaaaatgggtaactatctgagataatgaacatgttaatttgcttgactacagtaagtgtttcaccatctatatgtacatcaaaacgtcatgttgtacaccataaacatataaataacattttaaaacgtttatacaccttctgaaattgagtcagtaataaagaacctgccaactaaaaaaagctctggaccagatggactcatagctgaattctaccagacatactaagaagaactgataccattcctactaaaactattccaaaatatcaaggaggaggagcccctccctaactcattctatgaagccagcatcaccctgataccaaactctggcaaggactcaaccaaaaatgaaaatttcagacaaatatccctcatgaatacagacaaaaaaatcctcaagaaaagactagcatattgaatccagcagcacatcaaaaagttaatacgccacaattaagtaggcttcgttcctgggatgaaaggttggttcaacatatgcaaatcaataaatgtgattcactacgtaaacagaatcaaaagctggaacattatgatcatctctatagacacagaaaaagctttcagtaacaccctatatccttttatgataaaaacccttaccagactaggcatctaaataacatagctcaaaataataagagacatctatgacaaacccacagccaacatcatactaaatgggcaaaagctccaaccattcttcttgagaattggaacatgacaaagatgctcactctcaccactcctattcaacatggtattggaagtcctagccagaacattcaggtgagagaaagaaataaaaggcatttaaataggaaaggaagaagtcaaactatctctcttcactgatgatatgactctatacctagaaaatcctaaagatcctttcaaagggtgactagaattgataaacaactttagtaaagtttcaggatacaaaatcaatgcacaaaactcagtagcatttctacacaccaacaacgtccaggctgaaagtgaaatcgagaacacagtctcaattacaatattcacaaagaaaataaaatacttagggatatagctcacccaggaggtgaaagatctccacaaggagaacgacaaaatactgttgaaagaaatcaaagtgacacaaataaatggaaaagcatttcattcttgtagactgaaagaatcagtgttataaaaatggccatactgcccaatgcaatttatagattaaatactattctagtcaaactactaagaacattcttcacagaattagaaaaaaagtattctaaaattcatatggaaccaaataagagccagaatagccaaagcaatcctataagcaaaagaaaaaataaaacagaaactaagcccaagacatcacactacctgattttaaactctactataaagccacagtaactaaaagagcttggtactgctatacacacagacacctagaccaatgaaacagaatagaaaacccagaaataaagtcacacgcctaccaccgtctgatctttgacaaggctgacaaaaacaagcaatgaggaaaggactccctattcaataaatggagctgggataactggctaactatacacagaagattgaagctggacccccacctttcaacatatactaaagttaactcgaaatggattaaagatttcaatgtaaatctcaaactataaaaatcctggaagacaacctagggtatacttttctcaacatcaactgtggcaaataatttttggctaagttcccaaaaacaattgtaacaaaacaaaaatagacaagtgggacctaattaaactcaagagctcctgcacagtaaaagaaattatcctacacttgatcttcgtggatgaagctggaggccatcattctcagcaaactatcgcaaggacaaaaaaccaaacactgcatgttctcactcataggtgggaattgaacaatgagaacacatggacataggaacaagaacatcacacactggggcctgttgtggggtggagggagtggggagggatagcattaggagatatacctaatgttaatgggtgcagcacaccaacatgacacatgtatacatatgtaacaaacctgcacattgtgcacatgtaccctaaaacttaaagtataataataataaaaaaaagaagctatcaacaaagccaacaggtaacctacagaatgggagaagatattcacaaatgatgtatccaacaaaggcctaataccaagaatctatacagtagggaacttaaatcaacaagctaaaaccaaataaccccctttaaaaacgggcaaaggacatgaatcaacatttctcaaaagaagacacagaggtggccaacaaacatgaaaaaacactcagtattagtaatcatcagagaaatgtaaatctaaattacaatgagataccatctcataccagtcagaatggctattattagaaagtccaaaaacagatgctggtgaggctgcagagtaaagggaattcttacacatggtgggaatgtaaattagtccagccactgtggaaagcagtctggagatttctcaaagaacttaaaacagggctaccatttgacccagcaatcacattactgggtacacacccaaaagaaaacaaataattctaccaaaaagacacatgcactcatatgttcatcactgtgctcttcacaatagcaaagaagtggaatcaacccaggtgcccatcagtggtagattggattaagaaaatgaggtacacagacaccatgaaatactatgcagccattaaaaaagaaggaaatcttgtcctttcagcaacatgaatagggctggaagccataatcccaagcaaattaacataggaatagaaaaacaaatactgcatgttcttacttgtgagagttaaacattgaacacgcatggaaataaatatgggaacagtagacactacagactactgggaaggcgggacattgaaaaactacctattgggtactatgctcactgccaaggtgacaggatcctaattccaaacctcagcataatgcaatactcccatgtaacaaatctgaacatgtacctactgtatctaacatagaatttgaaaaagaagaacattactgtaaagagatagacatacaggtaatgtatttatgcaaaatatcatgcctaattcataagatgttactgtgttgccttagaaagtaggcagtacacagatggaattgattacctagtgagttaagcagagtttggataagcatagttataataaatttttgctggtatattagggggatgatttgcagctaatatcagtgatgacaaaagtattctgcactaaaacatttatccatctatgtttaaaaaagctattaggaaaactgagcagtgatctgggttttgttatgttccttctacttttaacctagtttcctccttggccttaattcccccacatgttcaatggcatagaaatagacaaaaaagtagttaatattatagaataaggtaactgtgggcattaaatgagatggtatatgtgtctggcacatagtaaacattcaattaatgatattgttgttcatataatgagtagtagtattagaaatatttgcagtaatatctagtgttaccttcaacactaggagcagaacagtgcctgggagtgctaattctgacaaattattcagttcctctgagctttccttcttgggtctatttcccacctctggctggacaatgtgtttaatgtttccaagccttaattttaaaatttataaactggggataatatttgtatcaatttcttaaagttgttttaagagattgaattactggcaggcagtaataataaattacagtaatgatgactattataattattgcatacatactaattgaggtgttattctagaatatttaggagtgaggggtctaacacagcactttctgagtttgaatcatttttctgactcttgttagctctgtgtgaccttgggcaaagtgcttagtctatgcttcagtttcttcatcaataaaaggggaagagcaatggaacctactataaaatgttgtcaggaggttgaaataaaataatgtgtataaaacatgtaaaatagtggctggcacatagtgtttaaaatacttattattatatcacttattaaaatgttctttgagataagtatgattttgcccattttcgatgggtacattgaggtacagagaagttgaataaactgtccaaagacacagagtgataaggtttggctgcgtgtgcccacccaaatctcatgttgaattgtaattcccagtgttgggggaggcacctggtgggaggtgactggatcatgggggtggatttcttccttgttgttcttgtgatagtgagtgaattctcaggagatctagttgttaaaagtgtgtagcactgcccccttcactctgtctctcccactccaccatgtgaagaagctgcttgctgccccttcacccgtccatcatgattgtaagtttcctgaggcctccccaaccatgcttcctttacagcctgtgcaactgtgagttaatcaaacctcttttcttcataaatcacccagtcttaggtagttctttctagcaatgtgagaacaaactaatacacatggcgagagtaattctgtcatttgaaaaaatctttgtcccctaaattgtacccagctgcttcattttgcaggcacttcttgctgttgaattgctaattgtgggatccactagaaaccacagctccctgaggaccttttatactcttcctgtttggaattgataggggaataaaaatcatcttttggaatagaatttgagacaataactgagctttatagtctctcatttcctcccacacaacttatgatttaatatcctgaatggtttgctattccctgaatgaagtctgaattgccaacttctgtgtttttgcttatcctatccccactaaatgaacttgccgttcttcctcctcaaccttctctgtctctattctctaaggctcatttcagtggggaaggggcttcacagaggagaggcctcctgagacattcacacaccctgtgcacttgtcacctctgatggctttgtatatcaatgatctctttgaatatctgtcatttcctctgtgatataaacatttagaggcaagagatctatcttggttatcttattaccactaatgcctagtatggcctgggcattagagacaatttattcatttattcattaaatattgattgagtgcctattatgacccaggcattggtcaaggtacaatggacattagaatgaacaaaaacaaccaaattctctctcccatgggcctgaaattctaatggaagagtcaccaattggacatcggagtggcaatgtcaagtggctggatggagacatggttctgaagttgataagcacagtctggctgaagatgtgaatatcagagtcatcactatataagtaatattaagaccatcaaactcaatgtgatcactaaggcggtatacattggcagaaaatataacagtaattctttcttttatggaatgaaggaatacatttaaaaaaaaaaattaaaagggccagggagtggcagggactccagagtaggaaagcccaaagcaggatcagcctagaaatgaccattttctaagaattacttttcctgtgggtttcctctcctggtggcatgtcacagagcttcctgttcatggtggtattcaccaacaagaaaataactgagcagcatggctgtatttaacattcattcaacacagacacagtttccacatggtctttacatattcttcatgtcttcaaacatttgcccagggataaacagtgtctctctttgagttcttttttcctcttagtccaggggcagcttgcatgtaaacatggcatccaaataatgatgcctaaactcatcttgatgtcaccaagatgtggcagtcatgtggcaaaaaatcataaaatctcccacaacattattaagtgaaaagagttggaagtgagttcagagaactcaggaaaaatgctttgcaaaacaaagcatgaaaatttactgtccagactctgctccatttctcccattagagtataatctttcatagtgtgtggtatatcatagcgatgaatccacatacaggatttctgtaatgatatgatgattttgacactgatccttctaacatctgctcacctaaagcattagtttcacactgctattgaaataaatgtgatttttaatatcctcaggaacactcaatgaagaatatgtccacctctaagcagagtctgaaaacactgtaatatgctatgggattgtttttctccccagcctcaaaggagaatggtttgctgaaagataaataaggttttatactgtcagttcatctccagaactcatcttttgttcttctacttcctctttttaatgaaaccttacaaataaagatggaccaatattaccatcaagaattgctgcctgtcacacttggtgcttcaaaacccttggcaaaaggcaatttgaaatgtaagaaggctaaacttgaaccctgcaatctaagcagataaaaaaacaatgctctgtattttatagacctggtggagtagaaaattgaggctctttgaagaattaggttcccatttcagcagaaaccagactcatcgaccagactcatgtttagctcaaatattactttttaggccaatgaaaatggaaaataggttgtatagctcctacgagaagctaccttggttaccattatgaaaatattacataaaacaaagaaggctctcatttatctaacagtctacacagtgttttgtaagtagtcatcattctacccattctggcccaaattaacagtaacaaaagtggaaaaatcaagtgggaagcaaaagacttaatcacataggtaacctgaaaaaaacaaaagatgcactaatcaaaaactaagcttgtttaattcttgtttcaaaaatttgtgttattcaagtatttaaagccaagatgtctaaaataaaactaccatctctccctaactgaccttcatggccttccctctatgttccttatcttgataaatttcaccattatcattttggtggagtcacttcatctctttcctatctttcactcaatatcacaaattgtttttcaatatttccaattacgcacaattccaccatgtgtttcaaatttatcctctcccttccaccacgattgccatgttttgacttttgtcatctcttgtaggcagggcagtctagtggtaaagacactaagctttggtattatgccattgaaggtaaaatccctgctttgatgtgtcataattgttaggtgctgggtgagtgatttaatttctttgtttagttttctcttttcagtggaggttgtaattgtaccttcctcacagacttgcagtaaatattaagagtaattgttcaggcttaaaatagcattatgctcaagtgttagctattgatactgtcttgcacagacttttcaagcagtttccaactaattttcttgtcgtctttctctttctctctcaacaatttgtcttctgacttatttttggtgttattttaccactgagtttcagttggttcattgattcagaagccaatatcccactaagtttggttattagttttgacacctgtctgtctcttgtcttcaaatattgttcttgatcctttgctagtcttttctctaacttcaagttcacatcatcccttctaaaatttggcacatatctagctccctctactcttggctgaccagccatccccaagtgccagacaagatgaaaaatcactcctcaacttaaaaacctaacttaaaatccccattgcctctctgcagagtgaatgcagcatagtgcccaggaaagttttcaaaatctggccccagatcactttgctggctgcttctctttcatacttcttgcccctcctgactggctaagctttatcttttgaagtacctagaatgctcctcctttttttcccctctgatgaaatgatgattcttctccagagggccctgctgaaatattaactctttgtgaaatgcacctaggtgagattgaatttcaccagtatcactacagtagttgtgatcatcgtagtagcaggagaatgacagcaaaaacagccaacatttagtgaccatgtattagccagtaactgttctaaacactttacatgctcattaatcctttgagcaaacttacagattatttactatcatttctaccttatggatgaggaaattgaggcccagaagggataagtagcttaactaaagtttctataactagttagtcacagaatgaggatttgaaccaaataggctaatcccagagttatcacgttcaactttttaactctagtatctctctagttttgcctctcacagcattcacagcactttacttgtattcgttgtgtcttagatctacatatgtgtctgtttatttcagtacaatgttagtcttcagatgtagtgatctgagtgttcccctgtgcctggaactattgcttttcaaatagtgttccataaatgtctgccatattgaagtgaaattcattaaatttgtcaacagaaaacaggtgtcctgacactcctacctctagctttcctatactaaaacctgtgaatgatttaatgacaacttctggtagatatataatggaccaggaaaaaaaacccgcaattttccttttttcactaagtatcaatgtgactttgggcaagccacttcatctctttttttttttttttagtttggaagatagagattataacccttgtgatctgccattatcaaaggggttttatgaaaatgaaatattcaaaagaaagaattttaaaacttgtaaaagcccatacacgtgtaagaaacaaatattctaataggtaaaacatatagccaatatctgaacgatagggccaattggtattacagcagggttaaatggagtttctaatgtttcccatgttctgcctttcatggacagtgaagtaccacaaaaggaggaaatctgtgttagctttgaaacctccaccatttgtcacagccagaaataatgccgtctcaatggctgctgcaatgctagatctggaaagagacttgggcacagtctctacttcttattcgtggatggtgaaaggcccagagagaaggaaaaaaaaaaaactcattcaaggggctaccaccatcttcctgcacaatatgtgctgtgtatgacggtcccatgttgagcaggtaagtggaaaaagatctagtcatatttttttgtaaaactgaccagaacgttgaacgtaactagagaattggtaaagtacagagactttgcagctccactgctgtgttcaatctcttcccctactcccatgcctcttgctgatgatgtgattcagaaattaaataatccctcatacctcagtttcctattctgtaaaatgggtataatcctgtccaccttacagagttatttttaggatataatgagttatactgtgcaagccacttaaaactgtaccagacacatagtaagttctaaatgtttgttaaatagataaaaataacatctgagggtttgaacatgacacttttagggcttaaaatgaaattgaatgaatcttgctttctattaagaaatacgtaaatattaaatttacatttaacatgggttatgcctctgttcttccacagattttcctgactacatgcctaggtcagagcctttagctaaattcaccaaggagttagcatgagattaattaactgtcagaggttaaacattaaaaaaaaaatcctggaggttactgttgtatttttaatgggcaacatgttggccattcaagttgctttttgcaaacaaatcctccaacagccaaatgctgatggtttctctgccaacagagcatctaaaaatttctatgatcaatatgctaccgggaaaaacaaaacacactgaaatgttatggtatatttcatgccaaaaacctgaaacacagttaggaaattatgttttgcagttatgcaaggcaatgtactgatggtggtttattgatgagtggtctagtctcaccataaccttgtcatattcatgctcccatttctgctcaaataaaaaacaaaaacccctggaatgaagctctaatttagtgaatcaattattttgattgaatgagggcactgagatagtgctgggtagatgttgttatgagttaaatttagataaaaatgtgaacacatacaaatatacagataatcaagtgttgaatgttttatcttttgtattatttcctgaccattatctagtaagtgcctttttgtcaaataatgtccattgaatgagtaaggaaaatgactactttattctttggtaaaagaactggggcatagagagataaagtgagttactcagagttattcaataaggagttatagccagagacttgacagcatttattctttctttaaaaaagtgtttgtgcttacataaagtatagtagctaggaatttcttgacattaagtcatccataaagtagctaaatcccttaatcctgtaaatagctactcaatatcaatgtacattcacgagccagctgtcagcctccaagatgccacggaattgggaagaaatctttttttttttgttctgagatggagtctcactctgtcgccaggctgtagtgcagtggcacgatctcagctcactgcaacctccacctcctggagtggagttcaagtgattctcctgcctcagccttccaagtagctgggactacagacgtgccaccacgcccagctaattttttgtatttttagtagagacagggtttcaccatgttggccaggctggtctccatctcttaacctcgtgatccacccacctcggcctcccaaagtgctgggattacaggcgtgagccaccgcgcctggcccatgaagaaatcttataagaggagtgtgactctaagtctgactgactcttagtgtgactgactctaggaattgtcgctgatcctgtagatcacaacacctggctcctaagatctacagactctggaaaacatcttccatcatttagcctccttctttctaaatgctactatggttctggaaggctgacctttgtggacaatattatctggactccttgcccttctggtttcccattgggtttggccacgggtgaagaggaaaagggagaggttgtggtacttatcatctgggctcgctctttggtgagttgacaatagctgcatttcttatccaaggaccagagcccttttttattgttacagctatagctatggctttttccaccttctagtaaccatcaacctagaaatcgtaactttcgttcttgctaacactgaatgtttcatagccttattggctcaataaaccctgcgcatacctttgcaaattgtcccttcattcaactatcccctgttgccctatttaaatatgcctttttttccttcctggaccctgactgatactgaatcatagaatttcagtgttggaaagtactggatttggagttgagtttctgatttcagatttttttcagaagctctgtgattttgagcaaataatctcccttgtctagtcttcagtttcctcatatgtaaaatagcctatattccttatagtaggctattattattactactattgttataatatgctgtaaatcacttaaaatgtgatgactatttctttaaaaaccatgtagtccaactggctctcctgggtgccaaccgtatgaaattttcttttcctctccttgaatttttccagtaagttttcttctatgggtatgacagtctcaaatcttgcagtcagacagtaagcgtatctgtatcactggagtaaggttcttttgggtataagtttttgtttattcaacttctcagttgtgggattctgctcaaatcattataaccttttcaggccacagctacctcaattgtgaattgggtaaaacctatcctcctgcaggcaaagggccagagctaatgttttctctctctctttttttttttccaatttaaagatttacattaggaaaaacagctactactctagacctataagagctccctcaatcaatatcagaggtcatcagtggagctcagcctgctaaagtgatgaagacagcaggctatggagtcagaattctagctctgccaactggggcatttgttttgtttctatgtgcctcagtttttttagtcattctatgtacctacctcagaaggtggttgggaacatcaactgagttcatacttgtcattgattcatgctcatgatatttcctatactaaatactttgcatggattattcccatgacaatccattttctgataatcgtaatcttttttgtctccaataaaccatggccctttcctccttctaggacactctctccagaccttcacattactggctttccttttattttaaggacttaaaagacatcttgtcaatgaggctttctctgagccaatcaagatatgtcccctgcatatattccctttccatcatattaccacaggtttacttctgctataacacttatcacttcccagattacctttgttttcttgtttattctctctcttcctacataagctccaggaaggtagtaaactgtgttccactcttcactagaaagtgagtgtctagtatcatgcctgccctatatggtctctaaaaatattgtggaatgaatgaccaaataacgaaattaagaggtggagaatttatgtaaataagtttacagtaataaacaggcattttgtttagtatgaggcacaacaggaattcaaacacatgccaggatgatgctaaaacccacaatgcccctctttgcctctttcaatagttcttggaagagatcataaaagtctgagctggctcagagctgtagcaaaagagacaaaaaaaagtgaaattaaaagatattcagagagaacactgaccagagtttagtagccattaagatggtgggtgggggatcattaagcagagagaagattccgacttcagcaactggacagctcttgatgccaatgaatgatataagacgctcagagtgagtgctacagagtgatggtgattaggagactacatctggctgtgcattcatccgcatcctgggatggaggttcaaagagctgcgggcaattgactgcctaggggatcgtgggatgggccaaaaatgtgaacaagacaattctttgttcacagccaaggtactgctgactctatccctgtctcatttcttactctggttgaggcgatactagtgtcaggtggaagacattctaaggcctaaattaattctcattagatgatatctattactcttgctcaactaccaatcaggtagctcgatgggagaaggccattggctatggcatagatctgtcacctcctgtcttgaagccatgtgtgttgcttcctggtacatttccaagacaatggcgctttttgatatttgtctgatagtcttctcaaacatcaaagtcaagatatgtggtttatttaacacagtagtttgggacttagaagttttgcctttgacattttaaaaatgagaaatacatttaattttcaaacatttaagaatgtctatggttcttcatgcagaaaatctttgtcatatgctgcttcttttaatgctttcgtttgaggcacaaacaccagaactaatagtttaaatctgtatttaacaaatgactataaaaggtatataatttcgaagtattaagaatattatgcctaaataacaacagaactcaagaagaaatatgtatgctttgctgaaaaacatttgaaaggccaatttgtggaaaaattttctaatataaattgggaagcttgcattcagataaatcagttcttttatccaataattcaaaatttaggggaaagtaattttaaaagcatagatagatatatacacaaagccatttatcatggtgctatttatattgagagtgggaggtaaaaagaggaaaactctaaatatccaaaggcagagaatgggatcaaatacaatatactagagttatgcaatgtagtattatgcttgccattaaaaatgattttataaaaagttttaatagcagggctgatatttatgaaagtatatcatgtaaatgaaataataaaaatttggtattgatatgacataattagtacatatacattgatgggaaaaaagatattactagttatttgtagttacttcatggtagcagattatgtgtgtgtggcgtgcacgtgtgtgtgggctcttatctttctttgcactttccaaattgactgtcctgaacatgagagacttttgcaaacatgataaaccattcacctttccaaccctggaggagaaggcgaaaaaggaagaggagaaggcaggagtcttatggggtccacaaatcacgagctaagtctagcgtaggttcagtatcagccagtactatacaatcccattagtatttaaagtgattctgatcatttttttagtattttctattttttttcctctcaaaacatccttttccctcacagttagttgaaaattgcattgcatcctctgtgaacatttatttgggggcatggctttatcagacgctggtgcagaagagtgctaacgagacatgacaattttctacttctctacgtgaatacagagatccatttgaaagttacattttacctatctacagtgtacaaatgactatattttcagcaaatatctaataaattggcaattttgattccaacctgaaaggagaaaagcaatgactctaataaccaacaatctttgacaaatagtggcaataaaagtgcctgcagcttcaatatcatgtaggattagggctctggcatttttctagattatggtcttccaggttgctgatgatgttatgttttgtgagatggtgtgcatgtgtgtgcaatgaaagaaaaaaatcacagcaatgtatctaaactataattttaatttttgtatgtgcattggcttagtgctaacgaaagttatttagttctgcctcctctccccacagaatataatgtaagctctaatagaagagctttctttgttttgttttgttttggtttggtttttaatctgttttagtcactgctccatctcccagcacaagaagcaggcagtgacatacaataaatatttgttgaatgaataagcaaattaattaaatcttattatgatgatatatcacctttggtcagtgccattgaaacaaattgctattctattctgggacttttcactgaatgtattatgttgtttgtggttctttccatattttctcatttgtgttgtggagacccatgacattttagtgcattcatatttttaaatcactaattgaatccatgagttcctacaaaatggtgtagcagtataaaaagcgagtaggtggagctgtgggttatagccccaatactcagggaattccacctagatttttaatgttgcattttctcactagcaaataacaccaccttctctgtctgattctaagagttgtttgatgcttgaaaaaaattgtgtataaaagaaagtttgtacacagagaatatttgtcaatgtatattctaagttatatagcatctttataaaataagctgaggatttcctttagatattcctctattttctactctttaagaatgccacaaaatagagaaaaagaagatggagaatgtgatggttaacctcacttgtcaagttcggcaggctatagtacacagtgatttaatcaaaccctaatctaagtgttgctgtgaaggtattttgtcgatgtgcttaacatctataatcagttgacattaagttaagcatagattaccctgaataatgtgggtgggcctcatctaatcagttgaggcttcctgaagaagaaatcctgcctcaagactgtgacatcaaatccttcctgaacttccagctgccagcatattctatgaatttcagacatgccagtccccataatggtgtgagccaattccttcaaataagtctctttacatatatgcatatgtacatgtgtgtatatgcatgtgtatgtatgtatatgatatgtatatgcttatgtgtatgcacatgagtatgtattggttctgtttttctagagaatcttgactgatacagggaaagaatcaacaaagaagaaaagtcacgtttatttaaatgacactttgtaatcttttttctaatctagtgatatttctgaatttgggcagtgtccactgggattatagacccagtggatgagagtcaaacaatgtacaaggtcatatgttaaagtgtccagctgctctgctaacaaggcaagcaataggaattcctacagttacttgagtccagtccccatcccttacatcaaacaaaaatgtcccagtgttttgcaggacaggctcctgtcactaagactgtgctgtcagtctgcaaaatggaaaatgactcctaattgcccaaatgttctcctgggtatttaggtaaacatgagtacatcaatagattgcttttgtagaatatactgattctttgtagagaacggcaatgcatgcaggcctaaagaaacgaaacaagagtttcggaggaaaaaaaaaaacaaaaaaacaaacttgctttgaatagcaggagacgacgttttggcagctgagcagggcaagagcttcatgagccgctctttaatgctgcgcttggtgctgttctgagcgtacaggaaacctagaagatacaggatcagttctgttaatgctgtctgcagagagaaaagggacgtgctgcagggtttatcagagaagccaggcaggaaggatcagggacgcagccatccactcaggcaatcacaggcagtgggttgggacccccgaaaggaaaaaaaaagtttgttttcttcttatttagttttgtttttatttctaaatgttgttttgaagataatgacgaacaagtgaaagcagaatcgtaaaatatatctattgaacggcaaaagattaaaaaaagccaccaaaaaaatctggtggtttttttttttttttttttggcccttagatcagggataaaacaagtatcactagaagagttaactggattgaaatttcaatattcaaaccagcgctaagggcccacatgacaattttctgctattgctccccatctttgattatagcagagatagatgcttcacataaatcattcacaccacaatcacctgttagtacctttgccttcctgaaaatgagaaaataaatgtccttaatatgcagcttcattagcatatactgacatgcccagagatgtgacaatctttcccattttttacatgtggacgctaatgaatggaactttttcaaacagactaattctggaagaagccagacaagcttgtcaaacattaacccaggaatagacggagcagtatgtgtgacagcagatacctggagatgactcaagaaaaatcaaaagtggctggacgggtgagcttgcaaactgctgaaacaacttttgatgtcaggagccaactatccaagtcagcatcaatttacccaccctgaggtctcagacacttggatgtcatgttaataggtaactagcctccccgagatcagcatgcaaggtgtcaaatataaagcatcagcgcagaaaacaatttaaatcgaggttctaccatctttataacaggaatctggcaaatgtatcacttgttccttttctagttcttatcttggaattataaaaaaattcctgaccacaagcctactgatttagtttcctaaatcatatgttgcacccaccaacagtatccactggctaaaactcatgtgtgtgtgtagagtaggatgacaaaatgaagtagtaaatacacaaattaaataagatcattcctctgattaaaagccctctaaaagcttcatgttgtttttctatcgaggacgccaagtatgatctggccctgtctgagtctctggcagcatttgcagccactctctctgctttctgggccatccactattggccacactaccctttttgcctttggtagaactcacaaagcaggccgtcctctggccttgacacttatgtggtatgaaatgtctcattcaactgctggttgagggtctggcatgtaacagaaggtcaataaatgcctggcaaatgagtaaataaattcactttggatatctaaagaagacttgattcatttcctagattagtatctaagtaagctttttaaaaattttactttaagttctgggatacatgtgaagaacgtgcaggtttgttacataggtatacatgtgccctggtggtttcctgcacctatcagcccatcatctaggttttaagctccgcatgtatgtgtagagtggggtgacaaaatgttataaatgtccttaatatttccctccccttgacccccaccccctgacagacccccgtgtgtgatgttccccttcttttaaacttgcaaaataaatctggtttacataaaacacaccctatattttgcttctgatttccatttctggaaggatgcaacgatttaactaccctctcctttgcaaactcctccaggacatgagggtcttactttagctccctacacaggcactctgctcctcccctttatgccatttcaaacctccgtgccaggatatgtgctgttccctcagttttgtcagctgttcaccaactctcaacttctgtatcccagtgcagccttttttttttttttttttcaagacagagtctcactctgttgcccaggctggagtgcagtggcgcgatctcagttcactgcaacctccaggttcaagcaattctcttgcctcagcctcatgagtagctgggattacaggtgcatgccaccatgcctggctaatttttgtatttttagtagagacagggctttgccatcttggccaggctggtttcaaactcctgacctcaagtgatccacccaccttggcctgccaaagtgccaggattacagacgtgagctactgcgcccagccccatgaggcttttaaaactcagttcaaacacaccttcctctggccatctttccctcttgtgtctccaacttgcctaaaagaagaaagacctcctccctcccctgcttcccaagctaactttgggagaaatttagcttatagtttaaatgataatggcccttccccaaaactaaactgcctttgtaaagctaatgaaagatcaccaggttaggaggatgagaggagcgtgaattctgctaaggtgtagccataagctattaccagccgttattctcgaggtcatgagattcataacttccccaattactcctgcagataacatcactactgtagaacctaagattggctttttgagatgtcttttcaggtttttgcatttctgacaatgaatggcttcgcccagacctgccaaccagtcctgtgaccctacccagaagccaactcagcatgaggaccattttccatatccctaggattgcaccccaaccaatcagcagcaccctttccattacccatcaactatccttgaaaaaccctagcctctgaattttcaaggagtcttatttgaggaataataaaactccgggtctcttgctcagctagctctgtatgaattaagctctttattgcaatctctctgtcttgataaatcagctctatctgggcagcaggcaaaatgaacccattggacaggttacagtatctgcttcaaaaagttaggatcagaggaaataatatataaagcacttatcacagtgacagccacataatgcagtccaaacaaatattaatcattttgtttcacttatttgagtataccctattccctactgtctcagggccttttcacatgctattatctgaatctaaacttctgctttactttctcttcatctggttaatgcctgttcatccttcagatttcagttcaataactttttgaggaaaaccttatagggcaaaccaactagattatgaacagttattatagatgcccatagttttctatgtttctccatagcaagtataattaaaacaattcatgatacaattacatatttgacacgtcttccctactgaaatggaagatggaagatgtctacttctagcctttacagaataaatgttactggatatgctataccactgtaaggaaccatataactggacaagctacatgagggaactctttccaagaattgaacaataaacaacatagaactgtgatgcttgagagaagaaaaatcccagaggtgtgcttcacaaatgccctggctcgcccctgcctggtgacatgttccttccatagttcagggaggtagagctcatagtcactgagctgaagtggcagagattagagttccaggctcctgaagtggctggaatttgtaggccagggttaagagagaattgatgtatgcgtgtgtattctgcaggtagctggtgggtgggaaatttgtgtgaaattaaatgtgggttattgactaagggctgggatatgcacgatatccaaggcttcccaatgcttagcaggcagggctgagaatggaatgaaataacacaagccacatagagctggaatgctgcaagttgttagagttctagccctgccagccttccaaagaagacttcactgagcacctctggcgttgccctgagaactcagaaaaaccactttgggagtaaggataatttcctagagtaagggccatagtgtatcactgaggtaatagccaaagttgactgatcctaacaaagaatagacctaaagctagaaagaccaaaaagagctgctgaactgtagaatgcttcgaaacaatattcaatatattttaaaagaaggcaacatgacccaaactccttacaatgtatcctaataacatcttttgtactataaaaaaattactagacatgtgagaaagcagaacaaatgtgacccataatcaagaaaaaagagaagtcaataaaaacagacattaggtagcacagatgttggaagttgtaagaaatgacgttaaagatagtcataataagtaaagaaaaaagttcagaagagaaattaaactacaaaagggaactaaatgaaaattctagaaataaaaagaaaattctaaaaggaaaacttcattagatggacttaacagcagactgagaactactgaagaaaggattatgagcttgaatagagatgaaaaggaagaaatctgaataatagaaaaagatttaaaaataaagagagctttactcatctgtgcatcatatcaaaaagtccaacataggtataattaaagaacataatgagaggtgagataaaattttgaagcaataatgaccaaaatattccacatatgttttaaaacacaagtgaaatctgttgaaccaaaagaagaaaacttaaagtataataaataaataaataaataaataaaagaagaatcacacatagctgtaggcaaaatgctgaaaatcaaaaatgaaaaaaggctttaaaatgaaaagagaagaaaaggacccgtacatacaagggtcaaataatgtaagaataatttttcatcaagaacagcagaaacaccagaaaacaatggaagagaatccttaaagttctcaggggaatacagagactatcaacccagaattttacctatgtttttgagaatgaagttgaaataaagatacttttagataaaataaacctgggataattcatagctaaaagccttgcattccaagaaatgctaaaggaatgtcctcaggctgaggttaattggcataatacggaaacttgactctacaggtagaaatagagagcacaggaaattgaaaatatgtgaataaatatattatcctgttttcctttcctactttctttgtttaaaacagcaaaaaagtattgtagagtttattacatttgtagatgtaaaatttctgacaataataacatgaaagttgggggagggtcaatggaattttaatgtatgatgcttacattttacatgaagtggtaccatatgaactcaaaatagtctataataaatgaaggagacatactgaaatctctagatacaagggaagcagtaaaaaataatataagaaggtatagtcaaaactccaatagaggaattaaaatgaaatatataaaatatttaattaatttaaaagaaagccagggaagaggaatagagggacaaaaagtagaagggatgagtagaaaatacataagatagtaaatgtataccccaccatataattaaatcagaaattgtattttttattcattactgaattcccagtatgttgcacagtgcttagtatataaaatgttcaatcactatctactgaaagcatgaaatcagactatatatcttttatgattgtctcagtatgtgcagatttgctacttgtaattagcagatgcatttagaatgtacatatatgcttcctcacagtgtgtgaagcgatccctaaatagatagctgtgtgtgaaggcactctcttaaggatgatactgacagaatgaggaggtgggactgaattccccagccaatcacactaaaagaaagttgatggtgaatctccaaactgccttagtatgtaggacatttaccctcacagagactaaacactctttgttttcattaatttattaagttaatatgtatcgccacctacaatggacagattcatatcttaaattaattggctacataaaccactgagcctaatgagagcattcaaaattaagtcaaaataatcctagtttacctcaaaatccttgtctttctccaaattaagggcctggccagctgtcataaattacatattccttttggtttttttaaaggttacatgttcaagagagtgaaaataagatgttctgtctaaaggctaccatgcctggtttgtaaatgaacctgttaaatgctgtatttgctcccacagcttactacagaatgttacttaatacaatatcatacttattacaatttttactataggagtgtaacaggtaaaattaatctctattttagtgggcccatgtttagtctttcaccatcctttaaattgctgtgaatttttttgtcatgacttgaaagcaaggatagagaaacattttagagatatctgggtttttttccattccagaacttgtgaggataatcatatttgcttcatatttatagtcatgaactcctaagctggcagctacaaccaagaaccaaaaaatggtgcattctgcttcttgtaattcatctctgctagtaaattataagaagcagggaaaatattttatttggatggtttctataaacaagggactataattcttgtacattatttttcatccttgctatttctttgagcagtctaatgtgccacataattatctaaggtatttgttttctataagaattgtttcacaagtattcttgttatcagagtagttgtattatatttcaaaatgtaagatgatttttaaaagcctgagtactgacctaagatgcaactgtatgaactctactctggagggcggggagggtgtcagtggaagtcgtaagacttttatttttttgtgccatcaaatacaggtaaaaataattgtgcaattctgctttttaaataggaactattggcctgcttggccctaaatggaagggctgatattttaagttgattattttattgtaaattaatccaacctaattctttttaatttggttgaatgtttttcttgttaaatgatgtttaaaaaataaaaactggaagttcaaaaaaaaaaaaaaacaaaattaagtcaactcccatacctctgcatctagaagtcaaaccaaactgctagtatactaacataacactttaaagaccataaaacaaagcaatacaaaaagagatgaaaaattacttttcatctcataaatatttgtccaaaaagcattctttataatgtacatattataagcattataaatgatgttctttgtagaactgtaaatatacagtggctacatagaaaaaaaatccctgctgtctagaatctaaccatctgcatctattataatacctatgacattgcagatcccgaattccctgaggggaggattctgtttgtttatgaattaactcatttaaaagcatttgttgaatgctaactatgtgctaggaactgtctcagatgctggcaataatgcaccgaatgagccagccaaaaaacttctattttagtggaccttacacgatatttaggaaagaaaaaataatcaacaaaaataaatagcaagttataaagtatatcagatatgaaggagggatggggcctagagacttctgttggtggatatggatatgggtaagaaataggacggggaaagacataattttaaatatggtggccagggaaggtttcattagagatatatttgggcaaaaatatctacataagatgaaaaggtgtcttatcctgtttcgattattaacaataacagtgtattacatatattaggtactaatatatatttgttgagtgattcatatcacttattaatttattaagttaatgtttattgctacctacaatgggcagattaataaattagttggctacataaaccactgagctcaatgagatcattcaaaattaagtttactcccatatctctgcatctagatgtcaaaccaaactactagtatactagtacttcaaacacgataaaatgaagtaatacaaaaagataataaaaagtaagtgtgtaaatatataggccattctaactgtgctctaactaaatgagaatgtattcatttttaccaattggaaaggttttatcttataatgcctgacattactgaaaacacgtcagcctatcatcatcttgattgctccatttttctggtcatgcagacctcagtggtggcatatgcaagtggtcattctccactggctgctttttgtgttacacaggaaatgccatcacatgtcagtgtcatgtgtcagtgctgagcgatgggccatgaattatgaattcaacaagtactgacagtggcaatgaaagtggtaatttcaccataatgagaactattcttatcttcctcctttttgcagtacagcagatagcaaaaacttctatttctcatgggttagcttggaaataatggctcgtactctattaattcacagtcccgatcagcttctattttgtacttttgaaacacggacaatgtttttcttcctagattttaagcctgtagaagtctggtggaagaaaatggcaaataatgtttctacagatctggtgtcttcccatgaatcaataactatgacaaaaattgggctgagcaaggtggctcatgcctgtaatcctagcactttgggagtccgaggcgggctgatcacgaggttggtagatcgagaccatcctggccaacatggtgaaactccatctctactaaaaatacaaaaattagccaggtgtggtggcaggtgcctgtagtcccagctactcagcagactgaggcaggagaatcacttgaacccgggaggcagaggttgcagtgagccaagatcacgccacggcactctagcctggagacagagtgagactccgtctcaaaaaacaaaacaaaacaaaataaaaatcaccaggagtttcaggggtactgtgatcccatctgtgttctttgagtcagtgacaagctgattcatcagtagtgtcatggatgctgggaatagggagtacatttttttactagttgcaaatatgaacttatttattaggtttgggcaaaagtaattgtgatttttaccattgaaagtaatggcaaaaactgcaattacttttgccccaacctaatactatgatgcctatttttaaagtggacttacagttcataaatactagcatgactacacaaacaaacacatacactcagaattcatttagtattttcaaattcattcctgaagatactaggccccagataacttggggttcatatgctggtaataattcttgcagaaaattgctgcccaaccatgcagttgttattggatcttgcagtcagccccaaatcattcacttttaagagaagtagcaacagtgttgctgactgaatatgaggaaaatacctacatttcattttttaactttttgaacttgggaggcagaaaatgaccttcctaattgacctgttttgttatgcttgattataaaatagtttgtgtatcagtttaaaagaaggcaactagaaggtgcttgaatttgctgaaaacgatctacagattccaaatgcaaatggagtaaatttgactctacttagagtggctacctaaatacacctgtttctcataaaattaatgctactctctgtcagcctttccatctctctatctgtctttctgtctctgtctcactctttcttagtctttgtgcctttgcttttatctttgtctctttgtctccctcttcttctctgtctctgagtttctctggctcaatgtctctctctgtctcattgttctacatctctgtttgtgtctctcctttatctttttctgctctgtttctgtctctaccccgactcagtctctctctcaatcaaggcagggtcctatttaatcttctttaccttggtgttgactgtgttcttaacaaaacatttagagagagttttggtcagttgagtgcagaataattattgcatgttatctgaggcaaatattagcaaacaactggatggtcaaaagctgtaatgctttctaaagccgcttctaagtgtgtttgtttttatcacctctctgctgtactggcagaactagccagagaatactagcagaaaacaacatggaaaaggcatcaattttccttgggatcttttaagattgaccaattgaacctcaattttcccttgctcctctgaacaatttgccaaaactacttctacagggctatcctttgtgtggggtttggaaattatctggagttccttataaatagggtgacaagaccttcgtttgtccaggatgctgccagtttatgggagttgtcctaacaccccatagtctgcacccccttttcatgttcaaaaatgttcttgtttaaatggtaaattatatgttcatgcaatattagcaaccagtatggtctgttccacagactaaggtacagtcattgactaagtgaatacttcattgcactgtaaacaatgtaaataatgcaatttcattttaaaaaatggtgttttaagaatagctaaattaatagagaaggtgaaataggaaactaaaaatgtttttgtgagcacattaaagctaacatttatgatggaaagatttggaactttagggttcagggagaactcatttgaatctaagcgctgccactttttgtttgtaaggcttcggaaaagtaacaacatcactgagcctctgtttttttttgtttgttttgagacataatctcactctttcgcccaggctggagtgcagcagcttgatcatggctcactgcagcctcgaactcctgggctcaagtgatcctcccgcctcagcctcccaagtagctgggactatgggcacacaccaccatgccccagtattttttttttttttttgtagaaatggggtcttgcgatgttgcccaggttggtcttgaactcctgggctcaaacagtcctccccactcagcttcccaaagtgctgggattacatatgtgagccacctcacccagccaccttgcctctttgatctcacctgtatatgaggtaagcagccaaagcaaaaaggaatttatcaaaaatgacagcagtatctttttggatataacctaaacctaatgtactatttcttttccgcaagctaacacaaataactcttatttatttttatattttttaattgagtttttgatcagtgagccatgatcaagctccatgctggagtacagtggtgtgatctgggctcactgcaacctccacctcccaggttcaagcaattcaccttcctcagccaccggagtagctgggattacaggtgcctgccaccacacccgactaatttttgtatttttggtagagatgggatttcactatgttggccaggctggtcttaaactcctgacctcaagtgatccgcacacctcggcctcccaaagtgctgggattacaggcgtgagccaccgggttgaagcatttttaacaatcaagcattgtaacttcaaacttttctttgggataagccaagcatgcctttaatatcggaaagcaagcgacaggtgagtaaggttgattcttctgatggcgagagaacacaaataaattgattcttaataggatttgggattacaaggtgtattttcgtgttggagtgtccattatacaatgaatcttctcctccaatgtcacccacagtaactagtatatattcttaggtattgtctaggctactctgttcattttatgactggcccatcacctgaccactgccttttaataacatatttgaagggattttcaggaaaaacagtcacttgtttccttttgttcattctttttattttctcttagtataaaatcctgcagaatctcatagtctactctaagagctttggcttctactcagagtgaaataaggagaaaacggaggaggattttttagcagaggaatgatatcatcatataatgttttattcaacaacattaattaagcacctatttggcactggcaaaaacatagtccttgctcttgtgaaatgtataatctaatggggaaggattaacaatagaacaagaaatgaattaaacaatagaacaagaaagtcctctaaatttcatcttgaacatgatcttgttctaagaaaagatgcagacaaataatgcctaagatgcaatgctctaacaacaataagaacaaagagaaccttctatgtgctaagtaccttacaagcatcatattatttaaccttcacaagagccccacttgtggaagataacattatgaaagccaaattatagcagaggaaattgatggtaaagatgcacgcagtttgtaagtggcagtatcaggaatgtgaacacttgttcatctgtctagctcctgggtctgacattctgacttctgtactgcactaacaatggctccacaaaatggaacacttattggatgtgtctaattgtgtagtttctagctgcagaaaatttgtttctctttgtggtatggttttaatttccttctctgcctctttggttaagcttcttaacccatcttgtcttgaatatagtcctgagagcatggtgtctttcattcctttgctagaaatgctacctctaattctatttgcagtaggacatccatcaaattcctggtggtattaaaaaataataatgtggtttaggagaaagctgcactaggagatccaattttttcatctgaaaaatggggctaataatagatgacactaatctcaaggaagttgggagatgaatgaagtaattgtttctgcaaaatgcttcaaatgccagaagaaataacatataatccattataatttttgatgtgagacagtactttcctttcctgagttcttttgtgtcactgtatttaattttcatcttttaacaatgtatttatattcaataaaagtctttattcattaatttaaccaataagtatttattggatataaggtagaccctgtgccaggcacccgggaagaaaatcaaatagaatagtcaatgaagcaaagtctttacaatcttgtgaatatccattacttggccatgattgctcattagaatcaccaaggtggctttaaaaaattagccatgcctgatcattccagaccaactgcatcaggtaattctaatgggaggccaaacctgagaaccactgttctgctttgggaaaatatgatgccagataggttttcttaagaactgtagacttttgatattgcaagctgattcctggtgggctagagttggagctttttagctcaaacactttttttttaaattaactgggccaaaaactaaaaatacacatattccacttagaatgttggatttctggcttctgaggaggaactggatggtctggcaaccttttgtctgcatttctgtatagcagaaattggatgggtctggtgaggagctgcccctttcacacaggacatgcatgctcggtttgccagtttcctctgttgcctatcacacccaacgctaagagacaagtcaagtgctattcatcttggttcacttaactcatttacattagctgcctggcccctgtaggaatttaacttttttactctcctctggttgtttacacatggacattgtaactggtttgaattgtgtctttcaaaaattcatgttcatctagaacttcagaatgtggccttatttggaaaatagaatgtttgcaaatgcaattagttaatataaagttatattggtttagggtgggccctatagccaataactggtatctttctggaaggagaagacagacacacagagagggaagcaggccatgtgaggacagaggcaaagattgaagggaagccagctaagagccaagaaatgccaaggatttcccgtaatgaccaggagccaggagaggaacaagaataggttctccttcagagcctccagaaagagcctaccctgtggagaccttaatgaagacttctggcctcctaaactgtgagagaatatatttatcttgttttatgccatccagtttgtggaaatttgttacagcagctctagaaaagtaatacacacatcagttaacagattttcaaaaacaccagagaaaataaaattaagccatgtccatatattcatcccctactgtatatagaacaatgtctgcacacacagaatcgccaaaatgtaagacaaggggctctacttgtagtgccttctcattagtactggtattttttttttttaattactgccaagctcactcatcccaggcaaattagtccaccacacactaccatggagtggatttctacttgtgtgaaattggcatgttctagattctgtactgctagtattaggtaaatatcagttgaggctgagcattcacaaagaactaaactaaaagtaaatattgtccagtttttgtttcaattaattaattaatcacatgtttattgaataactgatgactttccatatcactaacagccaaattccctaattagcaacctgtggacaacccaccccctccaacccaccgcccctaaatctcatctgtctcctcttctattttcctctaatttctttccttgccactgctggtcactgtgcctgaaatgtctcctctcaaaaatcttcaagatctctcccttacctccttcaggtctttattcccttgccaccaactcagtgaggacttctctcacagggcacttaaaactgtgtcctcacgaaactacttcctattctctttcaattttaccccataggttggctaatgttatagcctaaattgtacctgcccctccctccccccgccacccacattcatagtgaagttccaactcccagtacttcagattatatttggagataatgtttttaaagaggtaattaagttaaaatgaggccattagagtggggccctgatccaatatgattggtgtccttaaaagagaaagatatactgtgatgtctaagcccagaggaaaggccaggtgaggacgctgtgagaggacagccatctgaaagccaaggagagaggcctcagaaggaaagacgcctgctggcagttctgtcaggagatctgatcttggatgtccagcctccagaactgtgaggccagtaatttctgttgcttaagccattcagtctttgacattttcttacggcagcctatgatggtgaactttgtatgtcaacttgacttagctaagggatacccagatacctggtcaaatattctttcttggtgggtctgtgtttccagaagatagtagcattcaaatcagtagactgagcaaagaagacccaccctcaccagtgtgggtggacatcatctagtcctttgaaggcagaataggaaggcataggagggtaagttccctctcttcctcagctggggcttccatcttctcctgcccttgggcatcctggttctcaggcctttggactccagaacttacatcagtgcccctttcagactccaacttgattatgccactgactttcctggttctccagcttgcaggtggcctctcatgggactttttggtcttcgtaatcatgtgagccaattcccataataaatcaacctctttctgtttctctctttgtatacatagtctattagttctgtttctttggagaaccttgggtagacaacatagccctagcaaactaacagagctaaccacatgacttattgtccaacctggaacaccactaacaatgaatgaaggggatattattaataatgatatccagacacttggcataaactgtaacttcccatgtatatcaggacatttggtagccttatccatagtacctatcattataaatgcacaatgcactttagttagttagatgtttattgcctgcctctctccaccagatagtaaattccttgagggcagaggtttttgtgcttttactgctttatatctagcacctaagtatctgggacatagtagagtctcaattgaagaaactgaataaataactgtaaactgtaaggatgtggttaatgttcactgatctatctatatttatgtctatatctatatcgtatctatctatctctatctcatctatctatctatgaaactttctcaatgcgactaccaattattttgtacctgctattggctaagcaaggtactaggcattttacatatgttatcactcattttaacaacaactttgcaagctgcttatggtttctattttaaacttgacccaaatacctcagagattttaggtaacttctcctataccgctcagcatatagctaaagattcaaacttattgcaaaaaagatttttgtacattcttggcagttaaacaataacataaatgcagatttctagcttatcaaatttaatgatcaatacttaggatattgttaactgtacatgttgatgtgccagtgttatctacaaattatatcaatgtgggttcagaataaattgtattttttaaaaaagtgtgggtagaaagatctctaatgctttaatcctaaatcctctatcagcataacagaaaaatcagggacaacaaatcaatgtccctaagatggatatgagtagctcttcctgctaatttgatttttagtaactaattatttaggctggcacacaatgtgaaatattgtccttgaaaacaggccctgctgctcaacattttatttattagaaactgagccaggaaaatctagtgttaaaatttatcatagcagctgaggggttatgtcctgatgaagtaaaataatgccatgacaagatgatagatgttttctgatatcttcttatcactatcttgaccagaccaaaatattgcctaagaggattcttttgagttatgcaaagtgaagtcacattttgtatgcaattttgaaataggaccctataaataatcaagtcttacactatttgcaacttgaaaataatgcaatacacaagtttttgttacatttgtcaagaatttcataacttcaaagctggctggctgaatgaatggtgagctctttaggatattgtgctaaggtaatatcccttaaagcttgcagataaactctggacatccttattagccttatggaaaaatccactaagaccttaaactacttgaggtctccaagaacatattcttcaaatagaacatgatccctgtgtaattcactctgactaggcttcatcctaaacacagtggaactaaatttttaatcctgaaaatgctagcatcactcaattccattctacaaatatctgttgatgcttaggacttattaagtctgccctgatactttccccaaggatctcagggttttattggagacagggtgaacttgttaggcataaaataatcttaaaaatgacctcactctgggggctaatcctgtgcctaagtctgtcattcagaatgtgctactgtattgaatctatcagattctccagctcttccagatctcaatgaaatggaatatagggctccttaggaaacccaagaccacctattttagaaatatgctataactaaacattgaaaaaggtacattataagtgctgtcatatgtaagctttaaaagaatcacttataaaggaagaaatgaaacccggggatgatcagaagtctgaaaactaacggagtgtgtacattaacctggtagattactaaggccaccccataaactatgtttcattcacctttgtgtccccagcatcacgcacaaggcctagcattgactgttcaatacatatctgtttaatgaatgcatcattgttggttgaatttcaaaggagaaagagaggcaggcttctcttcataaataaatcatgactttttcaagattcccaaaacaattagttttccactaaagcaatctgaagtgccagatcctggcaaacctttctgtccctgggagacaagcacgttcagaaaagcagaaccttcaaacttgcagagccagctcatacttggtggccttctcaccttaggctactagttactgagagttggggaaagtggggaaggagcccagcactgtcaacagactttattggttgaagaaaacagtgttgttaaaacactcacagatcataaaaagaaaaaaaaaacacccaaggatataaaattgagaaaagatatctggagaaagcaatattgtgttctcgagctaaaatttcataggaagcttttgaaaatgacctcctgggtaaggaaaattatggatcctatctattctctgattgagcaaacacattgaattcaatacaatctcagcaccacatgtgcacagaacagagcaggacaatttgtctgataaatgcgtttatagcaacaatatttatgagatctatgtaggctttgagacattgagctgaagaagtttgagcttcatgttaacaatgatagcaacacaagccattttgttttctttgtgagtgctttacaaagcactatccaatttaatcatgaaaagaaaacagtcctatgagataagcatgaaaaagtttaggaaacagaaaatgttaaagctcaatcgcgtttagttgaaactcctttcttcagttcttcccatactgggtttctctttttctttatgtccttgttatttaaaatgtaataaggacattggtacttattggtctcatcagcctcacccggtagcttgttagcaatgcagaatcttctaactcactcttgagctactgaatcagaatttgcatttaataagattctcaggtgatttgtatgcacattaaattgtgaaaagcattatctacatggtgtcatattagtcatctggaatgcctgcttttggaatcttaattcattatgaatgagggataagtagagggcactgttataagaatatggtgtcaatctatgaatcttctcaaaacataatcagattcaaatattaatggcattggtgatacataggttaaagttatagactctgaatcctggttttgccacttactgtgtggccttgggaacactccttaactctttaagcttcagttcctcatttataaatgagaataagtatactaaactcaagaggttattgtaaaggtcaaatgaaatgagtacccagagtggtcacacagtgagtttgcagtcatatttattctttaagtatgacatgaaacagagattcactccagctgtctatctttccaagaaaggaaaaaaaaaaacacaaccttttaaagtctttcttttagattttcactaagtcattcctttgaatactatcatagagacctgctttgtgttagctttgatctttggaattctgcggtggtacaaggtcatgatgagcttccagtgaattatcccacaaggaaaccttgacacattttctggacttttcaccacagagattactcatgtcttctcatattctgattctaagaggccaaaattattagataatggggtgacttgaactctaccttttttggatacaagtctggcccttctagggttgatacacttcaaaaattcttcttaaaatctgtggaacaactgaaaagaagctcagataaattctcttttccaggagtcttggagacaaggggacagaggaagagtgatctgtgcagggatgctggaaaccacagggagactacaggaattgaatcctagaaaaaggagctgattacaggagggtcagctgaaaacaaggagccacggcatacccagtttagttctctagcaccatcctggcagcaccataccagccagcaaggtattaggttggtgcaaaagtgattagtattgcaccagcctaatattttatttttgttgttattgctattttttgagatggagtttcactcttgttgcccaggctggagtgcaatggcataatcttggctcactgcaaccaccacctcccgggttcacgtgattctcttgccccagcctcccaagtagctggggttacaggtacctgccaccacaccgggctaatttgtgtatttttagtagagacggggtttcaccatgttggccaggctggtcttgaactcctgacctcagataatccaccctccttggcctcccaaagtgctgggattacaagcgtgaaccactgtgcccggctaagcctaatatcttaaagaaaataactaataaaaaattaaatgactgtgttctctctggtatgtgtagtggcaacgtgaagatccgacttttgttctgagtgaaacaagaaacatggaaaatgctttatgaaaacatattacatagagatgacttatttaatattgtgccattgtttctcatatgggaataatttcctatatatgtggtgtgcaatttaaaattagatatcataaaccactagggtaaaaatatatgaggcctataccgggatgctgtttcagcatgcagaatcattattctttatagagctaacaaattcttaaaagacaggctgagagttaaggatctgaaaacactgcaaactatcaaaggcatacgaggaatttaacaatgcaaaatgaaatttaagtgaagtaccttagttcctcttcttgctttcctactgaacagcaaccctatgtctttctgtagaaatgtttattttgcaccattattttgacacgttcaaatatgacactttggtcatatattactgcatatttaagcatgagacatcaatcagatacatgtaagaaatatgttggtttggtccagaaaggcaggacaactcaaagctggggcagggtagccactataagacttcaaaagaaccttggtctccacaatcttttatctgaacctaaacgtttcctttctattgatctcaggtctttagacaaacccaaccaattgccaatcaaaagatggttaaatttacctatagcctgaagcccccactttgagttgtcttgcctttctgaaccaaacgaatgtacttcttaagtgtatttgattgatgtctaatgcctctctaaaatgtataaaaccaagctgcgccccaatcaccttgggcacatgttctcaggatctcctgagggctgcgtcacgggccatggtcactcatatttggcttagaataaacctcttcaaatattttacagagttttgctcttttcatcggcagaaattaatgagaaactagcaatgcctttaattgcctgagctggttacttgagcagactgtcatccacgcctccctcctctgaagccctacttgctgccccactctattagattatcaattttagatcaactgctgcaggtggtgcctggctctacttgatgggctcccctcagtttgccaaagatttataaaagcagtgttttaaagaatggcgtttacccactgagctaattttcctctcagttagaattccatcattctttagccttaagagtaaaaagtgaaaggagaatggaattaactagagaactgcctatagttctctatgtgactgttgtgttacccttctctaatagaataactctctgctcttatggtcaagttggtgtcatccagagatgagatacaagaatccagggaaattttttatcaatgattgattttatggggcattgatttataatagtaacaataatttaaaactatatatatgtatgtgtgtgtgtgtatatatatatatatatacagatatatagatatatatttgaaaccctaggaaagttatatgggcataaaaatttcattttggaatcatttgtcaattttgccttgaagattcagaagccttctggaattttctgaacacaaataattaaacagtataatttccacactatctctctttttaaaaagatgggtgcttaaatatacagaaaacaactttattattgatttttaaatgtaatacaaaacacctaaccaatgcacagcattgaaacaattcatcaatttatctggcatccttgattggagagtccttaacaaaatgctaatttaattaagccttaactgtttttttctgacaccctgattagaaaatgttcaactaataatataatcttaaataccaataatgttttaaatttttacaaattcgtgcaagaactcttgattcaaatttgatttcctttctgtctaaaccaatctatgaggtaacaattttacttgtgtttatccttggtcatctgaggatgtagcagtaaagaaacagtagtcagaaggtgtttttaggagaaggaggaggaggaagaggatgaggcatgggagtaggaataggataaagactagagtagttttggaaaaaagcatttaagagagacagttttttcagcccagttccaagacattagatgatgttattagaacttaaaaggaaaaacgttctgcttgctgaaatgacattttgcatataggaagtgtgttacgttgctagggctgctctaataaaataccacagaccaggtggcttaaacaacagaaatttatctcacagttctggaggctggacatccaagatgtaggtgtcagcaggtttggttactttcaaggcctctctttttgtcttgtatcgatgagcaccttctcactgacctcacatgcccttttctctgtgctagtgtctccctggtgtctttttctctttttataaggaaaccagccatactgaattagggtttcaccctaatgaccttattttaactttaatgagtaaaatcacaacctcacagattggtttagactgaaagaaaatctaattcgaatcaagagttcccatgcatgaatttcataaaatttaaaatattattggtatttaatattacacaggtagttgaacgttttctttcttttttttttttttttgtttgagatggagtcttgctctgctgcccaggttggagtgcactggtgcaatctcggctcactgcaacctctacctcccagtgtcaagtgattctcctgcctcagcttcccgagtagctggaactacagacatgtgtcacaacgcctggctaagttttgaaattttttttttttaaagtagagatggggtttcactgtattggctgggctggtctcaaactcctgatgtcgtgatccgcccgccttggcctcccaaagagctgggattatagctgtgagccaccatccctggcctagtagttgaatattttctaatcaaggtatagggaaaaaaacagttaaagcttaattaaattcgcattttgttcaccacctctttaaaggcttcatcaccaaatatagtcgcattctgaggtactggggtttagaacttcaacatacaaattttgagggacacaattccaccactaacgggtcaatttccccttcttcttctttcctttccccttccccttccccttctcttcctccctccctccctcccttccctcctttcttcctttcttttctttctctctttttctctctttctcttcctctctttctctttctctctctcttgtcgggcagcctcccaacagggggattttaataaatgtctgctgactcttgatggggcaaatcactatcagctgtgcctattgggctgctttttaacattgctgctgagctgttggctagtgaaacatgttaaggttcttctggtcatccgaagatccatgtgccccctcccttatcagtcccttaccccgtctgcactgaattattacaatagtattataactggttatgcagattcatctatgtctcacccttccatgagagcagtctgtctaaagcctagttctaacgaaaaagcccacagtccttcactaattcaggcaacacgtttctgccatgtctgccttgccaggaactccactagacataagagatacaagagagagcagtcaaaactttcatttgctcccccttgccttccagataaagtccaaattcctttgtataacatttagtatttagaccttacccacctcctcaaatgtccctatcctggaattcacaaagggctatttttcacctcctaaacatattttgcacattagagccaatataccctttatgctctctacttttctatctgttccccttcctatagaaaacctacacatccttccattccagctttagacccttgccattgcatattgtagtgagacttcatggatgtatggaatgaagaaggataatttaaatgtttctgaactgagtatctgggaagaatgaggaaggaaccattcaatagagacagagaaaggtgaaagacaagtaggatttgtaaggtttggggcattgagttaagttttagaaactccatgagaacacattgttctgatgtgtttattgttgaatcttcagcatatagaacagtttctgccacacagtagacacacaatacatatttggcttaatgagagtatatgtgtgtagtccttggtaagaaaatgatgctacctcagtagtcatgacccctttatttcaaaagacacacaaatataacaaaattccagcaccacaaaaaataacttgacccttgaggtttatgataatggaaactgagctttaaatgttaacacaggttagaactgaggaaatttattacggtgttttggaaattaagaggatcctccataggtgtttttggggtcaactaatatatattaatgtaagagttttgtctagaaatttagaagctctaactctgctactgttaattgctagatttgcaactttggttcagttattaaagttatctgtttaaatttctataaaatgtagacagataatctacctatctcatgggattattataaaaaatcaaatgaaataataaatatcaaaacatattcaaaactaaaaatatcattgaggtattacatataaccacactggcaataacagacatagtttttttgagtaaactgctatggacaacttcaggtaggaaataaattgttaaaaagcacattcattgagaacttaggagagattggtagttggataatttcaagatatgactgattatttactttggttttttgatttttgtgctgttgttagaaatgtaaatttttttattttttttctttgagacggagtcttgctctgtcacccaggctggagtgcagtggcgcgatctcggctcactgcaagctccgcctcccgggttcacgccattctccttcctcagtcaccggagtagctgggactacaggcgcccgcatgatatcaaattttcttgaacaactgaactattattaatcgtcaagttttttttagctaattccttatggacatttaatcataacaacctattctgataaaagagattcctgatccagaatactgcacattattgtaatgtccctgtgtaccaacttgaggtattaatctaattaaccaaatttcatgtacctgtcctcctatctctattgcagagcctgtcatcattctttttttttttttttttttgagacagagtctcgctctgtggcccaggctagagtgcaatggcgccatctcggctcactgcaacttccgcctgctgggttcaagcgattctcctgcctcagcctcctgagtagctgcgattacaggtgcacaccgccatgcccagctaatttttgtattttcactagaggcagggcttcaacatgttggtcaggctggtctcgaactcctgacctcgtgatccgcctgcctcagcctcccaaagtgggattacaggcgtgaaccaccgcacccggcctcgtcagtctttttgaaagtctaatagcttaaatactaacgattgccattacacacatcttaaactattaactatgctgaaaattcatttggatttgtttctttatgtcttgaagccatcctgtaatacccacttattgtaaagctggttaaaattcctctaaaatagatggaataaaattcatattgagcaagctttaatatgccattttcaaaagagaacaggtcaggcattattttgcaacagagaccaggttctagtgacatctactcagtgatgtttcccctgatatccctgttactgtgcagagttgaccatagttgtaatagctgttatttgtagaactcgatatagagttgcatggcttgggcacactacttatgctgctaaggctcagtttcctcacagacagagcaaggataataatagtacttgtctcatttagttctttgagaggttaaatgacataattcatgaaaagtgctttatttactcagtgctcattgtttagtaaatagcttgtaaatattacttattgttattattgagcataacaactttaaccacagtaaactgtgacaattggcaaatggaaacaacctcatgtcctccaatagggattggtcaaattcattatggtaactttagatgatagaaggattatgcagccattacataatctgttacagaggaataaatatcgacctctgaatatgctctagatctgctaagctaaaaagtaggctacaaacggtttgcttattgaatagactagaaaatcatatatgaaattgttactggtggttgcctttggaatgcaggagtttttaatttttttgttattttactttcgtgtttttctgctttcttcactgttttccatagagtgttatttcatagagcatattagagtgggtgatgttatatgcaagaaatgtatggcccttgtcactcagtgcaccacgcttcccatcattagatatccagttaatgatgaaaatggctatgcatatctctcttgcccatgaccccagcatcttgagattttataacacacacaactgtcgactgcattgcttatgtaaggccacacagagaacagactatcatcccccaaagcacccagtgaatgcttccattagggagcttggagcccactatgagagaaacagtcatgctcacatgttccccttagtcatttctgctgtttgggacacattactttggacacattaagacctacctatcccaaccttatttttttatgcctgcctgcactataaagattgaaaaaagttaatactcacttccctgtcttctttctattcaggactggtgaggtgatacaatgagacacttaccaatgtctatttcattttttttcatggatgggtgaaggcttatgcttttgtgatgacagtcatgactagtacatccttctctcttacttgtctagagagtaggtgcaattgagccactgcatttatcttacagccttaagggaaaggccaaaagattcccacagctgccagcaccgatatcactgagccgctaaatcaatgtgaacaaaaacttcttatttctagtcttctcattaagtgaggaaaataaatttctataggtttaagcagccactgggcagtttttcgatcactgtaaccccaaaatattcttaatagatacatttttcttaataccactgggatccagacctgatgcgtatctttttcgaatgttttgctataataatgattttcttcattctaaattagcttggatttctcctactggctcacctcactttagagtagtaaatctagcactcaaaagacttattttttttttaaagagggaaggaatttttgtgtgtgattatttgtgtgtctgtatgtgtgtgtgtgtgtgtgtatctgttacttgaaggggaggaagcttttaataataatgtacacctttgtcaacagtacatggccaagtacaattacgccctctcaagcatcattacccaacagatctatcacactgtgcctagttcactttttcctttgtcttctgcctagcctccttcaacaccactccaggatgaggaaagtgaaacatggggctgaacatgacaagaatagtgatcataatctatgtttcaaagaagaaatgaagcagaacgagcctaacggaaatttcagagaaagcttttagttctttttccctttcgtaaattctaacatctccctggtccttttgtccaggagttcagtactttcacggcagcctctgattcactgaaatgtacaatgtcttaccaaggttatccatccccatgttaaactctgttccaacataattatctccaataaaacttccctcttcttagtgtttgtaaagcaatctgatggcattgcactgaagatatagttatgcttggttttgcctagatcctctagccccgttatgcccctttgagtgtgacacagctcctagaggcagtctttggacctggttattaacggaagcttttcctcctcctttaacataagaacttcattttttatccccacatattaaaaaaagggatatcttcacctttaataatctgggaaactcacattgaagatttttacccaaaaagagaaaaaatagactccagtggaatggatatttctaacataagagaaaccataatcagacagattatgagaaaagtgaaacaaatctagtttgttttagctgaattgtctgtttcttacagggctatcctttcttcttactaaacaaggaaataacttgcctgactctgacaattacaaattactcttgtttgtagaaatgaccttattttatatgaccaacattacaatgtagcaagatgaccattatgaatattattcaataagtgcccagtttactgtcgtgtaaactgtgtttgcttacagcatttacttcctccatagtgttcagttttcatggttcattatttaagaaccatgcttacaaattttatataacagaaggaaccctaataaagtgtgagtagaaatagattggctttactgtaccatgtctagtggcttgagatgggttaaattaattttcaaagattatatacaaaggagaaaagggtgggtaaatttctggtaatagtttttgcaactttaatattttctgatcccattattcattttaaaagatgagtgcagtaaggctaaattgcattgttctaccgtcttcctgacatcttgatgacctaggttggcagggattaactgggggtttactccccaggctattccttttcgctgttataaataagtcagtgtagaaatggccttcactcattggattcacactctattttaaacccagaaaatacattctaacattttttattccaagtaatttataaacaagtttacaagtccgtcaaacagatttttgaatgactctattatccctcaggttgcagaaaccagaaaacttggaatcattatagaggaatttttgccttcaaataattgtccatgtggataccacactgaaatttctgaagcaataatctgatcactttttaatccagctcacagtgcatcaatgcttcctcagtacaactatgcttagtgataaggtcctctctaatttcgccccttgtttactttgcaattctcattttttgccatatacttccccaaagtaaggccttcataatcttgcactagtatggttacaagaaggcaaattattttacatttctggggctctgactagaattactcctctgcttatccttcaggttaagttctattaacagatatgtttttaaaactcagatttatccagattaaaaaggaagaagcaaaattatctccatttgcaaatgacatgatcttgtatgtagaaaatcctgagagccacacacacaaaaaattagagataaaaaatgaattcagcaagttttaggatacaagatcaatatgcaaaaataaattcatttctatgtgcttgcaatgaataattcaaaaatgaaacctaaagaaattcatttataggctgggtgcagtggctcacacctgtaacataacaactaggttttttatatataacaactaaagcgtaagtaagcaagcaaccaaacaaacaaataaattgaacatcgaaaaaatttaaaacttctgtgcttcaaaggacactatcaagaaagtgaaaagacaacccacaggatgggagaatatttttgcaaatcatatgtctggtaggaatttagtatccaaaatacatagaaaactgttacatctcaacaataaaaagacaaacaacctaattttaaaaatagaaagaaatttgaataggtttatccaaagaagatatgcaaatgcccaataagcacctgtaaggatgctcaaaatcattagtcattaggaaaattgaaatcaaaatcacaagagaccattttatactcatgggtaaggctataataaaaaaggaggacaattatttgtgtgggtaaagatgtgaagatattagaactctcattactgctggtgagaatggaaaatggtgcggccttttttgaaaacattttggaagttactaaaaatgttaaacatagagttaccatatgaccctgacatttcaatcctaggtatatcctgaagaacagtgaaaatatatgttcccaccaaaacttgtacacaaatgttcacagcagcattattcacagtagccaaaaggtggaaacaaccacaatgtccattaactgataaatgaataaacaaaaggtggtttttttcagccaaaaaaagaatgaatagtgatatgtgctaccacagaggtggatcttaaaaacaatgtaccaaaaaaataaaaaataaaataaaataaaaaagaagtccgactcaaaatgccacacattttagaattccatttatatgaagtgtccaggttaggaaaatccataaagatagaaagctgatgaatgttagccaggaactgagagaaagagggaatagcaagtaactgctaatgggaatggggtttcttttggggtgataaaaatgttctagaattagctagtggtaatgattgcataaccttgtgaatatactaaaaaccactggattgtatattttaaaatagtaaaatttatgttatgtgaattatatctcaatttaaaaataaattcagcttatctattaggttctctaggcaaaacttccttacttctaaggctactcccagcactccttctccaattacactactgcagctcatagttctaggcgatttagtgtagtggttaagcagctggacagaatgaatgtctttcttaaaattcctctgtagctgaccaattgtgagcaaattatttaattgcactgggcctcaacttcctcatctgtaaatgggataataatatacctcactcatagggttgttttgaaaattatctgaatcagtattgcaaagcacttgaaacagtaccaggcatggccaggcgcggtggctcatgcctgtaatcccagcactttgggaggccaaggtgggcggatcacctgaggtcaggagttcaagaccagcctggctaccatggtgaaaccctgtttctactaaaaatacaaaaaattagccaggtgtggtggtgggtgcctgtaatcccagctactggggaggctgaggcaggagaatcgcttgaacccgggaggaggaggttgcagtcagccaagattgcaccattgcactccagcttgggcaataagagcgaaactctgtctcaaaaagaaaaaaaaaagaaaagaaacagtaccaggcattcaataagtacttaataaatgtgctattaccattaaagcaattgttttatctattattatgatcgctataaacattcccctaaaattcatatgttaaaaccctaaccccaaggtgatggtattaggaggtagggactttggtaggtgattaggtcatgaggatggagtcctcataaatgcaatgagtgctctcataaaagagaccccggagagctcccgcatcccttttgcatgtgaaaatgcatcaagaaaatggccctcaccagacaccaaatctaccagttccttaatttgggacttcccagctttcagaactgtgggaaataaatttctgttgtttataagccactcagtttatgatattttattatatagctgcccacactaaaataattataattattatttggtatgtctctccagcattgtaccctactgtctatcactataggcacttagagatgtgttgtttttgaatggctggtcccagggtctaattgaagtcactcgtgcctcttcaggctcagcaactcaactatagtctggtaatgatatctttggccaaacagtatagaaataaacaacatggtgggttcagatcttaccaacgatccgaaccctaattagttgaaaacataccaagaatgttgcaatctgcttcttctaaaatacatttgctccaatgaccacagaaagaaagaaacctgcctttgcactagggtctttggaaattaatagaaagttctgagagacagtagttctgtgaaaaggcttagattttttggatgcctgaaagaatgcttacacaaccttgcagtaagagagtctaagaagaaaaacaagttctatcattgcttgtgttccctatcctgaagttttctctctccaaatgactgttttactcatcagtttataatcttctagcatgacatatatttttcaaagcgccaacaaacgctatttattctctacatgaacatttctcttacgtactccaggaaataaaatattatactcaaatgagttcagcttcttgtcctatatgccagccctggcaactgagctgtaagcaatactttttgaagttcaccctcacatctactcagcaggagtgcaaagcaagatgagaaagtggctcattactttttttgagggaggatgagttccagcaaaaaaattaaaaccacaaaatattttccttgggtgacatatactcagactcagcaaaagtaactaaaagataattttttggatatgtgtagctttacaagcaatctattaaaatattttgattaatacaacatattaattttgttctgcaaaataaagaaaatgcctatagagtcaccaggtttttctataacaataatctactaatgttagcttcaagccactctaggacatactgaattttcttctttcttcaatcaagggtttgatgttgtctaatgtgaaacaaggaagaaaatacatacaccttatatgtatatatataggtatatatacacacataataaataaagcaatagtatttgatctactagtcagtgaagaaatgttttatgattatagatacaatatttggaatatttgacaacatcactctaattttatcttctttacacagaaaaatgataaagagctttccctcagtttaacattgcaagcaatcaatgagattaaatgttgctttaatgccagaaaacaaaaacaaacaaacaaaaaagaccttggggcacattggagttgaaaggtcttttcaaactgcattcttacactctcccatttttcattcttttcccatatggctggaaaaggggaataaattttatgatgccccaaaatgcatatttttgagtttattcctgaagcagacagcttcagagaaaaaaaaatgaattagttcaattttccatgttcctctacctcctacagtccttcaagttactttgtggtcataccacaatcagctctgtccaccttcactcacaatctcctctcttataaaatgacccctaactctctcaggttctctctatgatttctgccccaaagagctctcttctctgacctccacccacatttcctgcccacgtaacctcagagtggctttttagaagtgtttacctctttgcagttgttatggtgcacttgcctcatcctgtaaaattgtggtgatgtggcctatttttctcatgagattttcagtagctttatgcactaatagaaaatatatgtgtggtttctgtgtgcaatctaggagaaaaaatagtaccattatgaagtagaggagtgaaacagtgggaaggggaaatgaattttccacgaacacatgaggttcaagagattttagaagttcattttaattggtagcccttagcatccactcaaaaaatcagaaataataatacttataatcacagcacattctggatggatgtagcttctgttagctaaacagaaatctagtttaaaattgcaaaaatctttttccctcccccgggcagttttgctcacagaaagcttggctgttcagctatcaaagccatttgttttcagtcttaactcttttgcagcaacagttaagccaaacccataatggaggaacatttttctaataacctgtgatatgattagcttctccaaagtcctaaactaaactattttagcttaatcccagttaacttaattgtggtcacactcattttatttttccttacctcccctcctgtcctttccctttcatattttttccttttttggttcttccaccattgaccatcttatgtttatatatatatatatatatatatatatatatatatatatatatatatatatatatatatatatataaaattgagatggggtctcgctctgttgccaggctggagtgcggtggcacaatctcggctcactgcaacctctgactccctggttcaagctattctcctgcctcagcctcccaagtagctgggattacaggcacccaccaccacgcccagctaatttttgtatttttagtagaaaggaagtttccccatgttggtcaggatagtcctgaacttgttatccacctacctcggcctcccaaagtgctgggattacaggcatgaaccacccgccccggccatgatttatattttttgaatgactcttacttcaactcttttcccgacaggggtcacacatgtagttatttaaatttctctgttttatgaaatgtctgtcaagcacctccatgctaaactgcttcaccctaaaatgggatagcgagcaagaccagacgtggtcctgccctcaggaagcttatggcctagcaaaagtgggtacctcattcacattaatcattccataacctcaaatgagacaatgtcctgaacgaaaataaataagatttttgagaaaaaattttttttaaaatgtgccaggactgagacactgaaaaaaagattgaaagcacagtctaagctgacatctcagggctgagtaggttactcttgagaaacaaatctggccaggtgtggtggctcatgcctgtaatcccagcactttgggaggcagaggctgcaatgcctgtatcaggaggcagagataaagtgtgattcttctgtgaaagcctcttctagtcagctagcgaacacatttgagtaaaacccaataacgacaggtatgtggaagagatcgccatgttgcagaccttttgttttaacgtgtccaacttggccttcctcaggattggagctaattttcacatgacacagctctaaccttttgcaggtaagaccttttcatttgatttttcctcctttccaagaaaagttttgagcgttattaaaggccaaagtactgaaactcttctggtggaatttttcttctttgtgaattacttacagtgggacgaatgattcaaaaccaatacattgcagagttggacggaatgtgaaacaagctcatctctgctgtttcctccagacagggctactctgctaaaccgtcaagcagatgaggtgttaatcttacagagctttctctgtaaaatgttctagggcctcacaacctctccactgggaagctgttcaacatcttactcctgttttgcactctaggtccatattcctctttattttaagtatagatgaagaactcttcacatacttgataataattggtttctctgatattaaaagaagtcatgggtactagatacaggagcagatccaagtctagatggtgtggattaatgtcaaaccaggcatatcttttttctcttttaatacttttatgggcttttcattttatttcctctgagaagatgaagagtactccataatcacaggaactctccatggttctccttgctctctcaacacataattaagaaattcctactggattccagatgccgtactaggaactggaattcggcagtgaacaagacaaccatgtttcctatcttcctggagcctgcagcaagagtggtctcaccctgccctcttctcctttcctctcctccctgtgtaatacatcatgggtttagaaatggaggaggtggtctattacccaggaatgcactttacatcaaaatcagggcctgtataactgagtccagactcaatccaaatatccacaagggaagtctagagagttaggaaaaccaaatctgtgagcaaaaatgtcaatggcaagtaggccaactgtaagtaagatataatctgggcacaggtgttgcagactaaagctcccttttgctaaggtgctaacataccaaaggggcctttaggcaaggcatccaggtataaaggcccaatggtaagaataacctattttcttttcttgttttttacataaaatgatacagaaagttagagtgattaggattattagcagggctgatgtgagaggaaaagattataatagttataacagcaacaggtatatcatgttttacaacttgacatgccttattcagtgtgtttcagtgaaaaggggtcaggcagacctgagtttcaatctagtagacattagcccttggagagcagaggctctcatgttctcatttgcattccaggctcctattattgaaccaggagcactgaaaggtattccacgaatgtgtgtggatgatggatgagtccttgctcggctgcctttgggcagtttgttagtagaagagtcctttctctcttcttactctcattttttccacattaaaaaaaaaagatagatcgggcgcggtggctcatgcctgtaatcccagcacttcgggaggccgaggcgggcagatcccaaggtcaggatatcaagaccatcctggctaacatggtgaaaccccatctctactaaaaatacaaaaaattagctgggcgtggtggcgggcacctgtagtcccagcaactcaggaggctgaggcaggagaatggcgtgaacacgggaggcggagcttgccctgagcggagatggcaccactgcactccagcctgggcaacagagtgagactccgtctcaaaaaaaaaaaaaaaaaaaaagataaatatgtatgttttaatattgtttggcgggggggagtcaaatgagaaagcagctggtacatggaaggtgctcaataaatgtatttctttaaagctttattattatctctgaatccatttacttaccatcaaactttagtggaactggcctcagaaacccaatttctggctaacacataaccctacattggtaattagaatcctcttctctttctgggtcttgctttgaagtctgaagaggacctgctcgctacttattttgactatggtaatgtttattgaatggctctaggccatttgaaatgagacaagtataaaaaatttaaattacagtattattacaccattcttaagtaattaaattatttcagaatgtaattttcatatattgaaatttataatatcaaattatatgcaattagacgcaatttctaagagatatgagggagaaatctatttaaattttctattttgccaaagttactcagttttaaaaccattcatttcacgtgattctttaattcttgtaggctaaatgactcactgaacaattcctggacagccctgccgatatggactaggaaaaaattaattgtccttgtatatctgtgctaagattttgaaatgattaaaatttgtataataacattaataatcattgtaaagtacagtacttctcatcttgaaaggctttcatttccatctttatgcaacccagacacattatgaacattctgcaaggagaggataacagcacaggctcacaatcatgaaaaggaatattgtggaaccatatgaaatttaaggtaactggggcaaaagatacacagtggggagaggcagggttgcagactggacttttgtctagtcatgtttttatgagacatgcacagtacatggagaagccaagtgatccctgtggacgatggagagtgagtgagaatgacaatgatccacttgcattttaaaaaagataagcttggggccgggcacggtggctcacgcctgtaatcccagcactttgggaggccgaggcgggtggatcacaaggtcaggagttcgagaccagcctggccaatatgatgaaaccctgtctttactaaaaatacaaagtaagccaggtgtggtggtgcattcctgtaatctcagctactcgggaggctgaggcaggagaattgcttgaacccgggaggtggagtttgcagtgagccaagtcacgccactgcactcaagcctggccacagagtgagacttcatctcaaaaacaaaaataaaataaataaaaaagataagctttgccacaggatagaggaggaatttgagtcaaaaagaactggaaacaggaatactagagaaggggttgtttctacagtccagttaagaggtgatgaagaactaaacaagaaaatgtactggtgatgggaaaaatagtaagacacctgactcaagaggtgttcccgaggcaaaactgacaggattggagatagagaattctaagttgacgccaatgtttaaaagcttgtaatatagggctgatgaggatgcagtgagagcgtggaggatgagatgtaggttactttggccgccatttgcaatttttgaatcaaaagagatccaccatggattattgatgagaactgttaatatgtgtttaaaatttcacagtactttcagatatattttctggttagagccatacaataactctgtaaaataggtagatatgcagataagagaagtcaagtcagttgagtaaggtcacatgggattaattgtcagattatttgtttattatgtcatgttactttttattaaacaaaatcagtgaaataaagctataggtaggaataaagctatttcacatttgaacatttatgaaatatctgctgtggatgcttaatatccattatttaatttaaaaaatagaattgcagaatttaaattatggaaaactgtgattgcaaataaattcaatgctaatgaataatatccttttgtgtgtgtatggttctgcatagaacattttatccttttgaaataaaagcaataatgaataagctttgttgaattgctaaaaacaactattaataagtctatgtgggtgatgttaacaagttgaatattaatgaagactatctctattatatttgtcatgaggccattgtctttacagtatgctagatttatgacatccataactataatagttaaacttaagatgaaaacattttttatctcaattaaaaatatgcaaatacatacataattgctcaaactcatttcagatgatgtgagcaaaaataaatggcaaaagaagcatcagttaaataacagtagacttgaatgcaggagacccatattccaagcccagctttgtgactgttaccagttttaggaccttggttactgtgatggttaactttatatgtcaacttgactggcctaagagatgctcagatggctagtcaaatgttccttctgggtatatctgtgagggtgttaactggaagagattagtatttctatcagtagactgagtaaagaagatcaccctcactaatgtgagtgggcatcatccagtccattgagggcctcaatagaacaaaaaggtagaggaaaggcaaattatttctttctttggagctgtgatatccatcttctcctgctcccagacattgtagcgtctggttcgtgggccttcagactaggagtgattacactactggctatcctggtttgccagcttgcagatggcaaatggtgggacttctagacctcataatagtgtgactgtctgtctgtctgtctgtctgtctgtctgtctatctatctatctatctatctatctatctatctatctcctattggttctatttctctggagaaccctgactaatacagtaaataaatttacttcatgtctctgaacttcagtttctttatctgaaaaattagagcatgaaaataaataaagaaaagttcttagagactataatgtactcaagtataaaatatggaatagccaaccaagaaaactatttggaaatatttcttgcaagatgcctacagcctaagatgtagaattcttcaaatgcattaaatgcttttaaaaatattgtttatagaatttatttttcaagttatgttcttctggtgtacaaaatatcccctccactgtctctaaaaaccttataaaaatacagttttttacagtttatagttaaacatgtgagtacgtgtgtgtgtgtgcgtgtgtgtgagacaacagtgtaaaaaagatggatttttctctttggattatgaacttcctcagtagataatttcaaagggagtgatttgtcaaaagactccagcagtgtcaccaaaatcagaaaatagttctttaaggtcatcatattaaaggccaagaatcatttacatgtagaaatcctgctgagtttgctaaaagtttgtctttgtttcacagtcacaagttgtatttctattcttccattttcttgcaagagaaaacactttaagtcacacctggcactgagctaacaccataagcaggctagctacatgatgatatttgaaacaaatttaaaattcacttaatgaactcaattattgtgtcagcttataaattttcacaccattcctaacattttcttgtcatttttttctgtcttgagaatgaggtatctgcagtggatactgaatcatcaatatcttctgcatggaactgtatctagtttcttcattgtactcacctatatagatgcaacacagaaaaagctcattgatacatagttcataatttgtaatagtgactctaagatagctttagtgtgggacagtctcagaataatattttgaatgaagcaaaagattatatactagagaaccaccaatgtatgagttaggactggtttccacctttccatggactatggtgacttaagcaaacatgcacttatttctacaaaacaataagttcagaagtacgtggtccgatttaagccttcttgtttgtcatgttaaactgtgacttattttctcatgctcaaaaatggctactgtatctttaggggaagaaaagagaatggaaagaagcagtgtctgacccactccactttaacattgcattaaaattttttttttcaaagttcaatggactccagttacactctaatatattcagtatatgtgtggtggcttgtcatgtactcaattacatgtcatatacccaagatcaaagacttactccatattcttcattgtttagctcctatcccatacagagagtaccacatatgatttatttttttctcattttagatttgaagtcattctgactcagggatatattaaaatgactgatacatcctaattaattttgagtatgtgtggcttgaattattgggacattgaatgctaaccacttgataaacagtcttgaagcttttgcacttggagccaaattactttgatctgattgagagcatgaaacagtccatattaggttttattatttctaggccattgcttcagtgtgagaaatccacatatcattctcactaccagaagctccatgtatcagtaatgccaagaatggaaatcctctcaatggtggtaccaagcctaagcacgatctttgtgtcagatgaactttgagatgctcatgatttcttccaaataatagtgtacatgtttatgtagtcagagaatcctccagtttcattcccctttatatatttttaatagagtctatttcaatatattgcaatataaaagttttctcttttctttctttttaacctatatcctacaatctagcacaagcccggaacatagtcaaaaataaatgttgaatgaacgaatgactttgcgccagtttctaagcctctgtaaactataatgtcctcattagtaagcatatatgtcaaaatgcttagcaatctggggtaataaaatgcattaacttggaatcagtttgcgtcccagatccacaatttatcatcttttagaaacttcaaaattaacttttaaattaatacatgcattcattcattaatttaactccatcgactgctctaaacactggaaacacataagtggaaaaaatgttttctagtagctcatagttcagtgtaagagacagagaccagtgcatgataaatgctctatttctttaccttcaggtgggttagtaatgcctgcttcccagatttgtatggactcagtacacaggaatccatgcctactctgccttaaaatatgcaaaaaagcacttttgaaatgttaaaatgatttgctaaattattttaacaacttttttgaaatgtgaaaatggtctgaatcactattttctcataaaacagggctagtaccatgcttgttgcataagagagaggctaattcattatatgcaaaggttacctgtgttgggagtcccacatacccgctcggtgagggtatttggatgaggattcacaagtcatatccatgactattggctatttgaatcagagcaactccatcctaaataggaactgggtaaaaataaggctgaaacctactgggcttcattcccagatggttagggcatttgaagtcactagataagacaggaggtcagcacaagatacaggtcgtaaagaacttgctcatcaaacaggttgcagtaaagaagccagctaaaacctaccaaaaccaagatggcgatgagaatgaccaaatgccatgacgacatcaggaagttgccctatgttctaaaaacaagaagcatgaataatccacctcttgtttagcatataatcaagaaataaccataaaaatgggaaaccggcagccctcaggggctgctctgtctatagagtagcgattcttttatttctctactttcctagtgaacttgctttcacattactctatggacttgccctgaattctttcttgggcaacatccaagaaccctctcttggggtctggattgggacccctttcccgtagcactaggacttattacatgcctatgatttattacatggttacaatttattattacgtggcaggaggacacaaaacaaaatcagcaaaggaaaaaggcacatggggcgaagttcagaggaaacagttaagcacagacttccaataactctttccgagtggagtcacataggactcacttaattctaccagcaacaaattgttacaacaccttgaaatgttgttcctgataaaagctcattagagacaaagtgcccaaagttgtttttggggcctggtcacataggtgctctctgcccaagatttgagactccgagaaggaaatcaggtgttcagtatcaattatattttttatacaaacatattttttatacacagcaaattacccttatcagacagcaaataaagtgaatcctcctgaaatccaggttcccaaatgccagacaatggtcaaccttgcaagcagtcctatctgtttagctgtttcaggcctgctctgttaaggctcttctacacaacgcctaagggcatttgattgaaaaagacacctggcctcttggggtctttgcaatgcttgctaaaggaaagtttgacaggtgagaggtgcaggaatagaatgcaactttttatcccctccccttctctgggcaaaaacaggtgaaagattggacaatagattaactatgtcatctgcttgcccacctttctgattttgctgcttatcacagtattcatcagagatagaacagaggtgattttaaaactctagtacattgcaagacaccttcagctgcattcatgaagagtgctgtttatattgtgtttctgtgctttgcatgtactagagcttacaatttaaaatcaaccactgcagaactctttggtaaagtgagaaatccatttataaggttcatttcttaagtcattcatcctgtaagttcagaattgaatgttttgagattctttaaggcacacttgtggggcactggagctttttacagctgagtttccacatgagtcactccaacatactgaactgcctggacattactgaatttagaaaagcttctcttggatttcttgttactatatggtatttgtgctttcaacttagtttctcttgctcaaatatttagtttttgaacactggatataattgcacagccaaaaataaatttttacacctctctaaacaaagcaagaaactgtaaaatccacaattagtatcatgaaatcttattgtaattttctttctttctttctgttctttttttgagatggagtctcgagtctcgctctatcgcccaggctggagtgcaggtgtgatctcggctcactgcaacctccgcctcctgggttcaagtgattcttcctacttagcctccggagtagctgaaactacaggtccatgtcaccacacctggctaatttttgtatttttagtagagacagggttttaccatattggccaggctggtcttgaactcttgaactcgtgatctgcccaccttggcctcccaaagtcctgggattacaggcatgagccaccgtgccctgcccttattgtagttttctgaagatattcttgctggtgttattttaggaatgtggctaaatggcctttatctgagaaagtgagttattattttagggagtggcaaaagaaaaagaagtgtgtgggaataaaatgtttaaattgctgttttcttagcagctataatagtgcatgcagctgccaggactacaatatttagaaaattcaaggatatttatctctaccttaaaatattttgaagactatactcgcttacatttgcagttctttgaaatgtgataatggttgatcaaaagtaaaaagatattttcttgattcaacattaatcctttcctggagtaactttacccccaaaaaattaaaataaaaggcaaaaaatatttttttcttgctagaattttaaattctggagtaagatttgagactgaattctaactgttttcagtatgtggtacagtttaaattaaaatatgtgtcgggtttagtcataatgtccttataccatttatgttgtattcaactgaatagtaacactgtcatcataaatgctacatttatctagattttttaagtgtatttttagagccagacaacaatgcaacagcatctatcccactatttttgtctaagcactgctatattaaaaagcttattgtttctagggcttgttaatcttgaagacatgatttatttctatgggactaatttattcaattcgagcagggatgatagaaaatactagaataaaagcaaattactttatggatatgtgcctgtgtgtgtaattggacacaaagaacaattagaggcataaaaatgttcaaataaatgcattttttcagagtatgaaaaatatatggcatttttaatgtcacctataaaactacgtataatctataaattatattatccttattgggactattcattgatcatctaaacagaccaatacaaattttctaagatagtttctttttttttttgtattttattcttcctattctaccttgatttaccaagatatgaaactacaaatcaataacatggggaacttggaaaatccacaaatacatgaaaattaaaccacatgctcctgaatgaccaataaattaaagaaaaactcaaaagggaagttaaaaaatattttgaaacaaatgacaacacaacatatcaaaatctatgggatgcagcaaaaacagttctaggataaaggtttataacaataaatgcctacattaaaaaagaaggtagattccaaacaaatagcctaacattatgcctcaagaaactaaaaaaaagaagagcaaactaaacccaaagttagtggaaaaaagaaaataataaagactagaatgaaataaaagggagcagaaaaaccatttaaaaatagtaaaaccaagaattagttgtatggataggtaaacaaaattcacaaactcctaactacctaaggaaaaagactcaaataaataaaatcagaaataaaagtagaaatattgcaatggaaacttcagaagtaaaaatgattataacgggctattataaacaattatgtgcaatatttaatcaggaagaaatagaaagcttgaatggaccaataaaaattaagagattgaaatatgaattcaaaactttgcaacaaagaaaagcccaggacgagatggcttcatgaatgaattctactaaacattcaaagaagtattaccaatatttaaattctcccaacaaatagagatagaagaaatacctgcaaacacattttacaaggcaagcatcaccttgatccctaagccaatgacatcacaaaaaagaaaactataggccaatatctctgatgaacattgatggaaaaattctcaataaaatattagcaaacaaaattcaacatcacatcaaaaagattatacatcatgaccaataggatttatccctagcatgcaaggctggtttaacatacacgaatgaaacaatgtgacacatcacattaacaggatgaaagataaaaaacacagaattttctcaatcaacacagaaaaagcatttgacaaagttcagcatcctttcctgataaaaactcttaacagtttatgtatagaaagaaaatttctcaacataatataataaaggtgatttatgaaaaatccacagctaacataataatcagtgggaaacagttgaaagctttttcactaagatccagtgcaaagcacaaatgcccacttttgctacttctattccacataatattggaagtactagcaatagcaatcagaccagagaaagaaataaaaagcatttaagtcagaaagaagaaaaagtaaaattatctctatttgcagatgatataatcccttatgtagaaaaccctaaagattccacaaaaaactgacagaatgaattaattcagtaaacttgcaggatacaaaatcaacatacaaaaatcagtagcatttttatacactaataacaacatatctgaaaaagacgctttaaaatcccatttatgaaagcataaaaatagttagaaataaatttaaccataaaggtgaaatatttgtataccgataactataaacctttgataaaaaaagttgaagaagacacatataaatagaataatattctgtgttcatgaatcaaaaaatttaacaatgttaaaatgtctgtattaaccaaagcaatatacaaattcaatgcaatttctatcaaaatttcaaggatatgcatcacagaaatagaaaaaaaattcttgaaattcatatggaaccacagacacataaaaacagaataggcaaaggaacaatgagaaagcaaaacaaagcttgaggcatcacacttcctaagttaaaattatattgcaaagctacagtaatcaaaaacagtatacaaatggcatgaaaacgaaaatgtggaccaacggaacagaatatagagagccagaaacttaactaattttcaacaagggtaccaacaggacaccctgaagtaaagatagtttcttcaataaatgattctgggaaaattggattgcaacatgcagaagaatgaaattggaccctaatcttgcaccatatacaaaaatggactcaaaatagataggagacctaaatgtaagatgtgaaaccataaaactcctagagaagaacatagggggaaaaattccttgatattggccttggagatgatttttggatatcacaccaaaagcttaggctacagaatcgaaaataaataaatggaactacatcaaactacaaagtgtctgcacagtaaaggaatcaatcaaccaaataaaaaggcaacatacagactgggaaatatattttcacacagcatatctcctaagaggctaatattcaacatttgtaaagaacacttacaaatgagtaacagaaacaacaaacagcttgattaaaaacaggcaagggacctgaacatacttttctccaaaggagaaataatggctaacaggatatgaaaaggtatacaacattgctaatcattagggaaacacaaatgaaaaccactatgagatatcacccttcacccattaggatggctattataaaaaaaaaaaaagacaagaggttactgctggtgagagtgtggggaaaagggaaatacagtacactgttggcgggaatttagatttgtgtagtcattatggaaaacagtgtggaggttcctaaagaaattaaaaaatagaccagcaatgacccaacaataccttttttggggattgacccagcaattcctcttttgagtaggtaaccaaagatgataaaaatcatcaccttgtaaagatatctgcactcccatgctcattgcatctattcacaatagtcaacatatggaaacaacctaagagtcaggttgacagatgaatgtataaagacaatgtggtacacacacacacacacacacagacacacacacacacaaacatacactgaatattcttcagccataaaaaaaggtgatcctgccatttgccatgacatggaggcatgggtatacctgaaaaatattatgctaaatgaaataagccagatagtaagaaaaatagagtcatgtatcatttaacaacaaggatatgttccgaaaaacgcaacatcatttgctgattttgtcatcatgtgaacaacacagagtggacttacacaagccgaaatggtatatactactacacaactagtctatgtggtatagcctattgctcccaggacacaaacctgaacagtgtattactgtactgtactgaatactgcacacaattgtaacacaatgggaagtatttgtgcatgtaaacttatctaaaaatagaaaatgtatggtaaaaatgtggtattataatcttatgggactaccatcatatatgtagtttatcattgattgaaacatcattatggggctcatgactgtactacatgatttcacttaatgtagaatcttaaaaaagaaggtcaaatatgcagagatagacaataagtggttcccagggatggtgggtgggggaaaaaatgagatgaaggtcaaagtatatgaagtagcagatatataggatgaacaggtctagaggtctaatgtacaacagaagatgataatagtctataagagtctaatattgtagactataatagtctataacagtctaatattgtagactataatagtctataacagtctaatattgtagactataatagtctataacagtctaatattgtagactataatagtctataacagtctaatattgtagacaataatagtctataacagtctaatattgtagactataatagtctataacagtctaatattgtagactataatagtctataacagtctaatattgtagactataatagtctataacagtctaatattgtagactataatagtctataagagtctaatattgtagactataatagtctataagagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataatagtctaatattgtagactataatagtcttctgtattaggttaaggctttttgttaaataagtagattttaactgccttttccccaacccccacccaaagataactatgcgagatgatagatacgttaatttgattcaccatagtaaccattttactatctgtagtttttccataacttgtaaacctcagatatacacaaggaaatttatttttaaaaagtgtacttgtcaaaatatgcttaaatacagattcaactttcagtttttaaagattttaacataaataatttttaactattttgctataatatacattaatataaagaaacaaatgagaaaaaaattgtcaggccattatatagttcacttatatgacaaaatgaagggtttcctttcaaaattatgtgtttgcatcactggaatttagagaaatcctcatagcttaagtattggaactattgtttataaaaatgcagagtagaagaccaggcacagtggctcacacctgcaatcccagcactttgggaggctgaggtaggtggatcacctgaggtcaggagttcaagaccagcctggccaacatagagaaacctgtctccactaaaaatatgaaaattagcaaggcatgatggcaggtgactgtaatcctagctacttcgaggctgagacaggaaaatcacctaaacctggaaggcagaggttgcagtgagctgagatcatgccattgcactccagcctgggtgacagaatgagactctgtctcaaaagaaaaaaaatataaaaaaataaaaatacagagtataaacaagctaattgtaccagtgtttatgaaatgtctagtaaacatataagttgttaaataaaatttcctattttagtcatggatgcatacaagtaaatagatatttataacataatctgataagtaaatgttctaagttaatgagaatactgtggaaatccatagagtagcacctaaatctaccaatagaaggtgttaaatttatgaaggctttccaaaggggtaatacagaagttggactatcattacatggtttcacatatatcacactttaatttgtgattatccacaatttcttatattttaaaacaatttcaaagtaaaatctggcatactcagcattagtaaatgttcaaaatattagtccaaacaattgttactttaagctaaaattatatggatttgactcttcatttccttcttttgccataactttagataccacgtctagctgaaaaagaaaaaaaaaaaaagaaagaaatttagccagtactgaattgaaattacttcataatgttcacaagtagggtggctacccgttctggtttattcagggtctcttggcattttatcaaacttccatgtactggaaaaaccctaagttccagcaaaatggatggttggccattctacccattggctcttctcaatcaatgtgatatatttccacacttctatttgcatgtgtgcattgaagtgaaaaaaggttttggtaaagttatgtcacctcaaggatcagaagcaggtactttattcaagtaagtatgaaagcatgcacaaaaaagatatttcctatataaatagcaaaaattatagaaggcaaatctaggagtgatgctataattgatgtgaacttttaaagtgaaactgaagttcataaaataattttacttggatttcttgtcctccaacttcctcctgtccatgtttttctgcctcataaacacacgtacccacatattcagtcagctcctcctatattttatcaaaacaaaacaatatgttctttaacccaatgtcatgtagcatggtggccacctcacctatgaatttctctcttaaagtttaataagacattctatatctattatcaatttactagatcattccacatcatgtgccactggagactattcttccttgaatttctcccctctcttgatttattgacacaataccctcccagttttcctctttcaaatccttggcaactttttgcctatctgtttttgggcttcccttatttcactcacccttaaatttaaatatttatattcctgagagttttgtcattgatttgcttctctctttaatccacacactatgcaagcattgcagatacaacagtggatttttctaaaaagataaaaatttctatcatcatggagcttaagttctagtgaggagaaataaacaaaaaataagtaaaaaatataaacagtttatcatatggctctaagtgctatgtagaaaaataaagcaaggaaggaggctgtattatactcatagagctgccttgacaaatgaccattctcttggctatttaaaacaactgcaatttattctctcacagccctggaggctggaagtctgaaatcaaggtgtcagcagggacgtacttcctttaaaagctctaagggaaaattattctttgcctcttcatcttctagtgactccaggcatttcctgactttaagcaacatcactccagtctctgcctccatcttcacatggccttcattcctgtgtatgtccacctttccatgtctccatgtctccaaatgtcccttgaggacacagtcattggatttaaaacccaaccaaatccaatatgacttcatcttaacttgattgcacctaaagagactctatttccaaaaaaggtcatactcatagggtctggatgaacatacatttttgagatacactattccactaactagagagactgaaaaatgcttgttgcagtgattgatggggaagatgaggaagtcagtggggtatctctaaccaaatagctcataggcatttcaaactcaacatgtccaaaattgatgtcatcatgacagtctcttaaaaccagcttccaagcgcttgccaaatgctgttccttggctagaaacatggggataatcttagatactcaaactgtctccatttcccaacaaactcgaaaccctgtcaatcctacctcttagaaatgtatcaagatatctccatacctaattctactacctctctctaggccattcttatttctgtccaagttttccaccccaattctctacactgccttaaaggaaacttctaacaagaataatagtatcatgtcacctctttgtaaaatatcctataataactctccaatatttgatataaaatatggtttcccttacaagtaaacagaaattccacccagtttttcttagcagatgcaactaaagaagctctaatgactcaaaagtctttttctgtggcttccataaacatttttcatcctgtaccaaccaataatctcagttcttctcctactacatctatccaaacttcctcaaaccagctatactcaaccagcttctactttctagccagtttcagctgccatcatcatcactccctcctcttcatgagcatcaacaatgtatctgatagtgtttaggcactttgtgaatgtaatttttaattcacttaacaatcctaatgatagaggtcttgtgattcccaggttatacatgaaaaaactggaacacaagagcttaagtttctttcctgcaggattcttaatcatatgaaagatacagttttttttttaacttacaaattggagttaacagtatctactctattgaactgttattcaaaggattaatttaacaaggatcactacactttataatcttttcatagaagacaaagtggtggtgaaagcaaaggggctgtctgtcataaagttggtcctgagcctataacaggattaaagaactgcagtttccatcctggcagaccttcagcccttagactcagtggggactacctaacacaaccatagtatagaaaacgggttcatttattcatttagcaaacatttattccggatctttcatgtaccaggtactaagattaaaagatatgttttttttttctaaaataaggccccgtcctaaagatttcatcatgcatacaggtacattgctatattactctatttataaagcaataataactttactccttctacaagtactgaatatttactctgagtccagtaccctagtaggtattaaaaaaaattccaaaattctaatctaccagggagaggtttacaatgtccatactcagactgtacaatactctccatatcctatgagtcttcactcatcccttcattctcctgtattatttgcatatgtctgtatcctgagctcatccacaagcaacaggatggaaaaaagcgtgcttcttgtttatttttcaatccctcaccatgtcccacagagcacaaagtaaaatagaataaaatttagccaaaggctggtacctgaaaaatggctagcaataaaaccacagttattaaagacagagtgcaggttgcaaaatgaataatagttactctgcgcatctgccctgtggctactctgggccctcagaactgtctagggcatgatctcaagcaggtagatcagtgtgctgatctgttggctgaaggaaaaaagcgtaacgttcttggtgtccgttctactctccagtacaggtttggcattatgaaaggaaagaagaggggtagaagcctccttaggaaaaagagctggcttttggtgctgaaacacctgcctagagtgtttgaccactgctgtgacttgtagcaaaggtctttatttagtgctgcataatctcataaacacatacttagggcatgagcaaaaggtgcccccaaggagtcttttttttttttttttttttttttttttttgagacagagttttgctctgttgcccaggctggagtacagttgcacgatcttggctcactgcaagctccacctcccaggttcatgccattctcctgcctcagcctcccaaatagctgggactataggcgcccgtcaccatgcccggctagttttttgtatttttagtagagacggggtttcaccatgttagccaggatggtctcgatctcctgacctagtgatccacccgcctcggcctcctaaagggctgggattacaggcgtgagccaccgtgcctggcccccaaggagtcttttgaaagcttttgatatttgatactggaagaaaaaatgtgatcataggaaaatcagaaggtcatatgaaatttttgtctttatcattaaaactgtttctcatcacataagaagaaagcaccaaaacctcttcaagttttaagacttgaaaaagttttcacatggcccaactttaagtaaaaattagagtctgctttggatgaagctacctcttccacactcggtcagactcttccttatttacagcccagctataagtctgtccagggcatttcagaaataagtaattaggccataattatttatgcaaatttataaagcctagtcataggtttaactttctttcttcaattctcatgtttaactataatggttattttacagagaaataattctattttttcccttgaaagtactatacaatgactttagagattctagaataggtgactctatcttgtttagtcattatcaattttaaattacaaccaaagaaacagccaagcaaacatgaacagggtttctcataaatatacatctttaagtttcaaagagacagagctaatgaaactgtcactttgaatgctaaatggagctcttgatgtgcttacgttgaatcttctctagattttctcatacacgaaattttgctagtttttttttttttttcagcatcagttcaccactcaattaaaggttggtgcagaatcaggagaagccaaggcaaagaggagcccagaaaagctcttgtaaacacaagagcttttggtattggctgactcagagaccagctatatttcatgaagacaaaaccagtccagccagggtcctatgactgtgcttgtcacctcttaataacctgggtcaccactgatccattttaccagtctccatcactgctctgtgttgatgactagcatccttgatcagctgaagcatcaaaatgatcgggctttaagtcagaatatttaagagcaggtatttccagtcatgtctcttacgtgtactgttgttggtcattgagcataaaactggtccttcccactctttgattacataactgcctctaaactgcctagactgagcccctcacagcttcacaaacttctccaatgcctccctatcaaaccctttccattgacatttctgaggcctacattttatcataaaaatgaaaacaaagaaacaacacctcttacatattctccaattgtatagaacaatctttctattgcttatttttactgacacatggcttagtccagtcccaaataaaagacacacatgcctctgaagactcctgtcctgagagctatacttcaacctctttatcctgaacttcacatagaaatttttgaaatattattttatgcttacttctatttctcatttctcattcactatgcagccaactaaaaatgattttaccctttatcactctagcaaacagtctttgatacacatatctatgatcacctaattttcaaattcagtgactcatttttcacatttttttttattggactgttctgttgcattagacactgtggaaattctgaaatctctaagctttcctgatgttgctctaaatctctcaccattccttcctacccttcctcacctttaaatgtagatttgattcattatatcatccttgatctcactccataggtttcctggagctattgcttcccaactctacattcctatttgctatctccttgctgaaacttgctcatctcagcttgcttggctgattcttccagatttccgatgcttccctcattgctagatgttaaactttcagcccataatctttttattaatttattatttatttatttattttttgagatggagtctctatcgccaggctggagtgcagtggtgcaatcccagctcactgcaacctctgcctcccaggttcaagcgattctcctgcctcagtctcctgagtatctgggattacaggcatataccaccatacccagctaatttttgtatttttagtagagacagggtttcatcatgtaggccaggatggtctcgatttcttggcctcatgatccgcccgcctcagcctcctaaagtgctgggattacaggtatgagccaccacgcctggcctcagcccatgatcttttacactaaacagcacatacatctgtgcttcttatctgaattgactataccactttcttacccagtcacccacactggaagcatcttggaccatccgcaaccaggctttcaacaaatcaccaaatactgcaaattttagctttaaaatatgtatagaatctgatgttttccacttcatccaaagaccagtatcctggtccaagcttttagcaatgtctgaactcctgaaatagcacctaacttagttctcaaccttgagccttattcttctcatatgtaaactcctaagcaatgctctacgaagatacaaaaatgactacgtcattccactcctagacttatttcttacaactgcctgacttgtactttatgtagatctctcaatccatcaaccatttcgcaatgatgtgcctctggttttgtggtggtcttctccacctaggatgcctttctgttacttctacttgcaatcagctcttcttcatctgtccattaaggcacagcccagtcaacatttcttctaggaaggctccctgaccttcccttcttgcattagatgcaatttctcagtcgttctaaaatgagtaattattatagctgtcacttaactattttgtatttatttgatcttatgtctgtctcctcaacagcctttgagttcttcgaggaagatggctgtatctcatttatctaagtagtgtcagcatatgcaagttgctggacacaaaatagtcaataaaactcttaaattgacaacttaggaagtgatccaattttaattttctttcgttcatgaaaagtagggataaactgtgtttttcatgttcagagattgatgaaattcatgggatatttctgaagatctttaaacattcagcatataaaaattatgaaatacatttcttgtgtagtaatttcctataagggatattctgactgttggctctttcttcagaaactaaaatttcttagaaaataacttatttggattatcatctaattcagactttctttcaagcagaaattttatccaggctacaactattgatccagataattattcttatcattacttcttgtatcagtctttgaactacctttgtccatgttgttctgcttctagcaaagactaattaattagtagaggagaacatgaacatcagctgaaccgctgctgtaagaaggtagagaaagactgtggagaaaatatgggctcagagatagacacactggattccagtctcaaccatttaatgcctgagtgacaatgagcacatttctcagccactcttggcccatttcatgtttttcaaaatgtgaataacagtgttactcggtataattattttgagacgacatgagttaatgcttttaaaatacctggcacaataatttgaattcccctttccccatgagagttgacatgcacctactggataggaaagcctaaaagaactaaacacatgtttcagtatttaactatttgcatgctctctaatttctattcacatgtataatgacaacaggtcttctcaaaagatgatttctcagtaaaataaaattaaggcaagaatgacatgaaataatttttccaacgttagtagtgaacttatttctgctttacttgactggttgccaaagtttttccttgactatatgaaagaaattgggtaaacttttcttaattggcaaaacaaatccactccgaagtaaaagttacgaaacagatgttttctgcttcttaatagaaaagctagtacagaaaggaagttccaaatggaacattctggtggtgccaaaggaacggagaaagaaggacaaaagaagaacttttaaaggtagaaattctcattatgatgattgattatttaaacaaggttaatttttcgaggcttatgaacctggtaaatttaagacggcaaacaacaaaatgctactgctaattagacatccaatgaaatgccatacagaaaggttaactattttaaaaaatgttatgtaatcttctatttcaaatgtcattgttattagttttgtaatagagctcactgacaaaacagacatgaatatatcttccagagagtgaggaggaaatattttattagttgtccagtatatagagaaatgagaaaaatattacaataaattttcatccttcatttgaaatattcacatttaatcatttctgtaggaccggagttattttgctttgggcagacctgaccctaggcagatttgaaaacaacaccacaatatatgcattgagggcctactatgtgctaagcactgaggaaataacagtgaacaaaacaggttaaggtttctggccccacggagggattctagtaggggaggacttgaaatagggaaattgtagtgtaatgtgatgtccagtagtaacaaacactaggaagaaagaccgtttagagattgttattttcctgaccacccagcatagcaataatggaaacgtttggctggggttccctcaatgcattccctggccactgctgcaatgagtgagagattaagtgagtgtgaggagaagaattacatggtgagcactggataatttccccatcttaaccaacctgtaaggcagcctgaaccatctccatcctccagataaaacagctaggatttaggaaactgaaggaactcagcccaggtctctcagctagtaaactgttaatgcagtttctctgacccaaagtctgtgcaaatagaacatctccaaggatgcagaggcagtgaatcacagaagtagctgcattgcttctcctttaaggtgtgaataataagcaccaggtggtttgtgcgtattatcttctttggtccccaccacacaactatgacgtagggccattattatccacagtgctcagataaggaaactgacactgagggagggttaaataatttgttcaaagtgatggtaggtctataatacaaactaatctctgctatttccttcttttatttttatttttatttttatttttgagacagagttttgctcttgttgcccaggctggagtccaatggcacgatcttggctcactgcaacctccgcctcccgggttcaagcaattctcctgcctcagcctcctgagtagctgggattacaggcgcacaccaccatgcccagctaatttttgtatttttagtagagacggggtttcaccatgttggccaggctggtctcaaactcctgacctcaggtgatccacctgcctcggcctctcaaagtgctgggattacaggtgtgagccaccgtgcccagcctctgctatttcattctaaggagcttatgtacttttccttgaggttgttgacttcaaccatgaatcaagatcaatatgtttgattaagaatgcattgatcaaaataaggaaatcccagagtacagctgcagaatgtataaatgcaggcattgcatttttttattcaacctataattatttatgttgacatttattactacatatctttaaaaatataaccaactgaatttggtgaggaattcagtgatgctataatggtctctgttcttctgaagatgtgtggctgccaggatagtggtttgtggagcatcagctacaaatgctcttagaaagcagcagtgtgcatgccaaccagtttatagcctataagactgtattctcttcttatgaaggttgagcatctattaatagctgaagctaccatttgtggcagaggcaatattttaatgcttaagagctgggtttcaaatccttgctctgcaatttactacaaattacttgctgcccactgaagctttttgttaaatgctcattatattgctgaatgcttattatgggccagggactattctgtgcactttaaatttaatcctcctaataatcccaggatggatggctaaccccattttatggaggaggaaactgagctcagagaggaaaaatgaatcatgaatggctgtacaattaataaactgccaagctggttttgaaccccaggtgtctctaatagtttcctccactacatgacactgcaggaccaatgagaaacagtattgagactatataagaaacagagtcagctttgtaatcagggctaagcatttagatcccatactagctcaacaaggcactgtttctccagttctgtcaaattattgacaattttgatttgtagtccaatctagaataaaatgtgcaagggacatattattgagagcacaaggaagactatgaatgtcagagagaagaatggaaaggttgattctgagagtctaaaatagggaatgggttagctaggttaatcaaggtaatcacaggaggccttgaccagttgctctacctaaaactcagtttccttcagcttctgtaaagtagaaataatcatacctagttcattgggtgattatgatcaaaagtgtgaaaataagaccagcccctagctccattcctgtgcatgcacacattgaccatagatagccctcaactcaaccccacgttgatcatgctccatttttctcagctgcagtgcccctgaaagggaatctctggccaccatgagtgatctggaggagcagtttcatgtctatgctgagggtgatttccatccatgacatggtcatgagaaggacaacagagacaccttgaaagggactggagttgcatttccatagaccaaagactaatgagccactatccctttcactcaaggtgactactgagcaatcagctatgattacacacccctccatgactgaggattctgatcctaacaaggcataatggaaaattcacttgtgcttcacttcacacatgatgaaaaactaaaatacaatgattggttttctctttgtcagccagatgggttcttcctaaatgcaaatccacagaggctgccccactgtgatgaggctctgcactcatcatggcagagacaaagaaggtttgcgggtttgcctggcagcttgcccgaggctttgcatcggctttgggaaaaccagaggcctatctaagcctcaggctatccatctgctgccaggtagccctccctctgccttcatcctaaataaatctgttttggaggagccaggaagctttggggacaagatctattcactaactcatatgtaaaaatgccacctacatctggcaaattcaaatttctgttttctgagcacgtgtttatacttatttattgcctctcttaggtacagttagatctccatgaaccagttcaatcagacttaataacttccccaatgatcctagccaaaataagaatgtacctgggaagagaatcttagcctcagaactgcagttcagaagagcagctcttcttgaattctaccacatgcctttgaatctcaggagatctgggccatcaaaagtccatttggttccaatgtctcactctccagagtgtggttgatgaaccagcagcttggacatcctttgggagctgtgactaattcttaaaaatgcagaatagcaggtcctacccagacctactgattcagggcagcaatctaacaagaatccaggtgacttgtgaacacactgaagtttgcaaagtactggtttggaggtcattcaaccatcttattttccagagagggacactgccaagtgactttccagaacatcccacagcagggtccatttagaattccaggactcgaattcagttgtgttggcaagaacatttagccctatcttgaaatcttctgggcctttgtttccgtaacactaaaatggggacattcacaactgccttgcttccttgttggtatacaatgtcataatatatatgaaagcattttatttcaaagccttatgcaaacaaatatgtctactgttatatccaaccaaactcacttgaatcttaaaagatgtgtacgtgtgtgagtgtgtgtgtgagcaggagttctaggtatagaactgggccatatatgacaaattttgccctactttagaatgtaacctaattctcagactgcttgccaaaaaaaaagaatcctttctcctctaactctcaaaacggttcttaaaatagatgggccccccagggactccccgacatgtttccactgttagagttcaggcagcctgagatcaacgggttttatttcagatgatgttcgatttggggacatgagctcaggaggacacgtaacaggttagaggtgagcagccctttgtatttttaactttaaatcatggcagtcgctcaaatcaactatagtttagtagacaaagggaatgagaaagataaatataaggactgagagaagagaaagaggataaacgtaaggagaaggctgctgttgatagtatccactcattaaaaaaatactgagaagtttatatatgtcagacactgctctaagtattttggacacggtcatgaacaagaccagcaagggtcctcactgtgtatggcttatgttctggtggtggtgggtaggaggacaaattgaaaagcaaacatatgtccaggaaaacttggggtaggaaaacatgctttgagaaacctagctactgcacaggttctgcctatggttggatagccagagtgactactctgagatggaaattcaaatgaaaccttaaggagaagaagccatgtgtagataagggggaagagcttcccaggcaatgtgaatgctccgaggtgagaatgagctggggagtttcgagaaacagagagaaggcctgagtggtcagatggtggtgagcaaatgcagaagacgagttagcaaggttgagctaggttggatcatgcagggcctgtgtgtacacttaggaatgcggacacctgtctgagtgcagtggaacgtcattgctagctcaactagtgatccactgagatgtagaaattggaatcttggaatctcagcacgcagcacaggttaatagactgaaagcaggaaaatggaagtgtattttctcattcttctttctgtccttgatcttttcctcccttcaggtttttatcaaattcttattatgtgtcaggcaccgtgtcttagtgagcaatggactaaccttcttatgaagttaaaatacattcattggtgtgagttagtacaggatacctattccaatctaataaaatgcaggcccctaatgaaatggggtcctaatctgtgggcccccattgccaacagcagtggctcttaattgcagattgttacagtgaagaccttgttgcatgcaaaaatactaggattccattcagatgtattgaataagaatctttgaggatgagcctgcctatatgtatttttagtatactgcataagtgatgctgccagctgtgaacgtcctcttcttgagcctctctctggcatacctggcataccttctttgctcccctaagctccccttagtcttgagggatcagtgcaaagtctgtttcctctgttatcatcactctaacttacgtgactttgcctgatattcctagtttttgatgttttttagttttagttttagttttgagatggattctcactctgctgtccagggtggagtgcagtggtgccatctcggctcaccacaacctccgcctcccagcttcaagtgatcctcccacctcagccttctgagtagctgggattacagacatgcaccaacactctcggctaatttttgtacttttagtagagatagggtttcaccatgttgcccaggctggtctcaaactcctgccctcatgtggtccacctgcctcggcctcccaaagtgctgggattacaggcatgagccaccacacctggctgatattcctagttgttaagccctcaccaatcactcgttctcagctagaggtaagctccttgaggacttgagctgattccttttcatttcatcctcctagtacttagcctactttacatgaatttttaatatgcaaatgattattgccgctgattaaaataacctaaatacagagaagcctgaaagtgtaaggaagctccttaactttattttggttccttctgagataaggagaatgaatcataacaacaacaacaacagtcaacactgacgttgaaattgttaatatgtactgaacacttaccacatgcacatactgggctaactacacacggcagctcctaatctgttattcctcatttacatccctacatgcagttccctgcatgtgaccctaagaggaccagcttggtgggaaatgttctcagtaaacttggatcccagttccaactcatcactgattaatggtatggtccctttcaatctctctgagcctcagtttacacatgtggaaaatgagatggtaaactcttgccttttctcttttccagggttgccatggaaagccaacgaggggatacagtcagtgctgtgaaaacacatgttaaatgaagaagaagaaagataactcctgcttctgaggcaacaccagaattccagaagcagcagaccattgacttttctgctccagatttggaccttattcatttgcaatatttccaagttgctggttaaatctgaacttatctaagaaacaggtagtaagtgaaagagaatgtgagtcaatataatattggatgcctgaaaagtgcagcaaagcaaaatttaataagtattgacccaaatctttcatttctagttcaatttgacaataacctttatttttcaattaattcagccagagtttccctgagtcaaataccaggctggactttgcaggacctagagctcagccattgcctctgctcctatctttccagccagctttgagggggctcttatccgggagaggagagatattacccaccacatgtggttggagggagcatcttcgttacactcctgcagcatgctggctgccagcaaatggcctcacattctgtgggaaacaggctttctgcctggtgcagctttgcttaagcacaccgttcaggacgtggcctgggagtctcccaaggaatgggccagtatcatttgaatggagtcaataaaacctgttagtcaccttatcaacaatatcagaatcactgttgttcaaaaactgtattattggagatgactccctttgttttgttttctcctattattaaaaaaatgataatggtcctatccccaagaatggtaatatataacatattaatatcatgttatatgttattaccatataccatgtataccaatgtttaccaattggttcctttttctcacaagaaggaacttatgggcctttacagaatacatttcaagccatgtgtaagaacctttcactgcaccatttaatggaatccctgccaccccttttgtatggctggaactgaaagtcaaggatagggagtaactccctataggtcacaccattggcaagtggccgtgattttttgagcacatgatttcatataaatgtggcctttctcctgctattcctcacagctcttctgaataagtgagagtacggtaacagcgactgctcgcatgagagggagaggctgagatttaggccactttgaaaaaaatcctttgcaaatactgacgcatagtcacaatgttttctgtagcatcttgaaactcttgaataaaatgtattatgcttgtgctagtttaaaaaatagtaccagtacccctacatattactctaacagattctttgcagcagagctgatgatagggttatcccttcagactttctgcctacaagctacattaattggatgatgcaaagattggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttatcgcggcactattcacaatagcaaagacttggaaccaacccaaatgtccaacaatgatagactggattaagaaaatgtggcacatatacagcatggaatactatgcagccataaaaaatgatgagttcatgtcctttgtagggacatagatgaaattggaaataaccattctcagtaaactatcgcaataacaaaaaaccaaacaccgcatatcctcacacataggtgggaattgaacaatgagaatacatggacacaggaaggggaacgtcacactctggggacggttggggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataaataaataaataaataaaaaagaaaatgaaaaggaaaggaaatcatgaaaaactatacaattttacaaagcaatcatgaatatcacaaaatccagagaaataaaaatattttttaaattaaaaaaaaaaaaaagaaaatactggttcttcctgtgcagagaaaggagaatacatgccttccttaccaggaagatctacagctattagctagcatggaaaggagaatacatgtcttccttaccaggaagatctagctgtagctagcatggctcactattatcttagctcattagtctttttaaccttttgcctttgcccttgactttgagtcatgatgttgagtagaaagtgaaaaacttgccgaggggttcatttgattccgttgttgtggatatttcattctgtccacttttcctgggcagaatgaataagcctgagttgcttttaatccctgttgctgttctttgatattgaaaaacattctactcacagtcgatctgcaatcaaaatccccaagccactgagaagagatctaaccagatttctggtggcaatttaactccaagttgatgcaatcagtactctgcacaggcaagtgtgatgccattaaaggcttttccccctttgtaggttcacaaacttagcttttgcaagcagtagagaggcatgcaatgtagaagccaatgagattatagcctctgaatcagatttcatacttattaatgcaatcatagccttttgctccaggacttttacaaaaccaacttgacttcttcaaaccaatttgatgctgaaatggtcaaaaagaaaagtaacattaaatgcagggtgcactctctgctgtttttgcttacctttttttcttcccccattctccattttaaaatacgctctttcacagaataccactctaaagttacgtgggcatttgctttcccccaaaattcatatattgaagccctagcccccagtgtggctgtatttgaagatggagtctctaagaaagtaattaaggttaaataaggtcataaggttgggacactgatctaataggattagtatctttataagaagacacgtcagagtgctctctctctctctgtctctctctctctccctacgccctgccccacctatacatgcatagaagggagatcatgtgaggacacagtgggaaggcagccatcagccatccaggaagagagccctcaccacaaaccaaccatgctggtaccccctggtctgacttgcaggctccagaactgtgaaaaataagttgtttaagccacctattctgtcatattttacagaagcccaagttgactaacacactgttaatccaggaaattctaaatattttaagaaatttggtagaagtattagatgaattattcaaaagtccttggaaatgggattaaatgataaaataatactaacgagaaaaagtttgatcctctagaaatgattaagtaaaagatattttttaagtcttaaatgagaaccagcagcttctggtcatgtagtttccttcttaataaaagactaaatgctattccccctccccacacactcccatgtgcacactcatatatcttttttgaataggtgccatctaagtctgtttaaaggtagaaatgtttctgtacaattgagacctaactaacaatatattctaagtgtttgagtgttggatctggactactctgttttactgagttaatgaatttacttttcttatggaagaaagcaagaaaatgagggaagaaaaatctgggtttacttaagtagttgaagatagcacaatagattttcaaaatgaccagtcaaaaaccatgtattctaaagggcccaggatggctggcttcctttcttttcttttctttgtttcttgttttagatataaagtaaatttgttaaaaggcaaagttggcctttctccaacaacaataataatatacgctttgcttactgctacacctcttccaataacatggtgcctagcacagagtgggtacgcagtaaatataagtgaaatatttataagcgatatatagatgaaaaaatattatcaaggaaaaatccagctggattacaaatacatttaacaggaaaaattaaaaagtgacttctgcttttattattgatctacaataaaacttgcagtacaagagattgatataatattaaatatttcaaccataatctatatcaaggtatttttttttctcaaaatgatggtgactcacaaaagaagaaagtaaagaaacagattatatctaggcacttctatgtatttaaatattcaaagaacaaagggcatttaattttatccagatttagaatgacatgttcattatctcaaaactcctttatataacagcaattctgcattcaattatcacaatgtatgtactaaagttattaccatacttattctttccctctgaaatacaaaattttactatctagtaattgataccttgacaagatgtaaattttgctgaaacaaaactatatgttcaaagtcataagaaaccatgtaaggttgagaaatattaagagactgattgctcattataaatgatttatattaatagaaagcataacttttcccatcacctgactttataccacttttgaataactggtcataataatttcatgccagatttaaaaaattaattattaatttaatatgacagcattctttggatgtgaggactctgaaattgtctaacttattgtcttggtttgtttaggctgctataataaaatatttttttgaataagtaatttataaacaacagaatttattgctcatagctctggaggctgggaagtctaagatcaagtgctgggagattctgtgtctggtaaggacctgttgctcatagatgacaccgtcttgctgtgtcttcccatggtggagtggctgaataaactcccccagtcctcttttaataagggcactaatcccatttatgggaatggagccctcatgacttagtcacttcccaaagcccttacctcttaataccatcattttgagaattaaagtttgaaaatatgaattttggagggacacaaacatccagatcatagcacttgctaaggtttcataatgagtctgcatttgaatctttgtctgtttgactcaactgtctttccttgcagtcaagtgtgagttacctgttcctcctctattatccactctaacggcttctgtgtctctcttcagggaacctcagagtggcttcgtcactgattgcacatttacctttttgtagtatctgtctgtttgacttcataatgactaaaagcaacttgagacttctatatggttggaacctagcacagtgcataatattcaataaatggaccgggtgcagtggctcacacatgtaatcccagcactttggtataagcctccaaagtgaggtgggcagatcacttgagctcaggagtttgagactagcctgggtaacatggtgaaatccgatctgtactaaatatacaaaaattagcctggcatgatggtggacatctgtggtcccggctacttgagaggctgaggcaggaggattggttgagcccgggaggcagaagttgcagggagctgagatcgcactccatcttgggtgacagagagagactccgtctcaaaaataaataaatattcaataaatacactgtaatttactgaatgaatgaatgaatgctgttagtaagggccatctctgcattttgcagataaacatgctcattctcaccttatcaatattcccccaaactcaagaactcttctccatgaagagctatcaaaggagagtcattatcaaaaatggaccagccctgattcttcttcttctcctagaaatgtaatttagcctttgccctactgagagtgggccatgcaggttagcaagtagagtcacgggaaacacttccctgtgtttttctcaagaaacaggtatcctttctgtgcaggattttttttataaaggcatcgtgcaagaatcacaaattaacatccctatttccaagctatgggcatatgcattccatgtgatgtatgtctctgagcaaagttatcttcaagaataagtattacctcaagtgaacacaagagctcatgatcaaaaatgatggcaagaaacctggagaagctcaaagtaataaacagagttcacaatccaaaagcaagcacaccttctaaggtgttcaaaatcaacttcttagtattctgtacgaaagaaacatgttattttcatagaggagagttggaaagatttcttaaaatcctgggtctcactcagcctgagaccatgaaatcaatgtggttttgtgcaaagtgaacattacattagtgtttgttgatggaataattgaaattttaaagtcaaatcaatagacacttatttaaggaatatcaagtactctgcagggtgtagagatgattaaaatcacaaataatttatagttcaccttagtcaagaaggtataatcatcatgataatgtaaataaatcgatcaaggtataatgaaacaacaacaagagtgccacaagacattacaaaataatctgccaagcgggtcaggcagcaactgattatagaatacatgaggcattcatacaactctgatagcttcatgcccatacttctggcagatgtcactaattagtcacagggctttatccttctgggcccaggcgcatcctcaaaatctttctcaattttgtgagtttggcagccaattagctacagctggctggcaagataaagtctatttgtcatccctgccttatgctattcctcacatgccatggtttgggtcgtgtaatcctattatgtgccaccctcttcgatttctgggaaatgatctgaattgactcatctttttcaacctccgtcttcagggtcatcctttattgcagagactggaaagtgaaacactactttcaatccctttgcaggtagtattctggatttcagctccacttgaatttggcatggaggggagagaggcaggcccagggtagaggaagcatagttctgtgattgtaactcctggggatggagggttctcgtattgcagtggcagcttccttgagcatggcagaggtctggtggctgggggttgttactagaagcctcacctgcagcctattcattcagcccttctgactagcttctatgccacttaaactgtggtaatacaaccctttcttaaacacggcaaaatgtgtctactgtctgtaactaagtcctaataaatgtagcgcttttccctcaaacagctattaatatgaagtcttcccagaacagagtacagtgggtctctactttcctcttatctagaaactaggtatctgtgaacagacactgataccctgttaagtattggaagcctccaatcatcaattctgcaactaacagtctgcccttgtgtggttccctcatgccctctgagtctcaggttcttcatctgtcaaatgaagggattggttctgattgatggtggggccacttctatcttgagcactctttcaacttgataaaatgattttccagcaagtcccattcaatccaaaatactgaaaaatctacttatcttctaagaaactttcttgaatagagtgaaaaaaaaaattgagtagacatagttgattacctgagagaggtaagttgaagctatttctgagatacaaaccttacagtttaaaaaaactttaggtattccaatttcatttcatagatctggaaactggacaaattatatgcctaaattcacacatctatgggatggcattcagttcttttagttccatattaagtaatatcctccttttattattttaattttacttcagagcaaatgggaaggttatagtgcttattattggaatggaataaagaaggtaaatggcaatttacattatttctcagcaatgctcattagttatgtgaccagcccttgtgccaagccttcttgtgtattcttgacacttactgaccttctaacgcctatcacttcacacctatgtgtgattttctaaatttgattagaccttttttgacagggatctatctttcactcttaggaatcctctatgtgccttacattatatgggcattcaataaatgtttaccagtattcaattgaattacccttaggagaaaataaactttcacctctgtaagaaatcagatgtataaaaatgcataatgttttttaaacgttttctcttgggaggctgaggtgggtggatcacgaggtcaggagattgagacaatcctggctaacacactgaaaccccatctctactaaaaatacaaaaaaattagccgggcgtggtggcgggtgcccgtggtcccagctacttgggaggctgaggcaggagaatggcataaacccgggaggtggagcttgcagtgagccgagattgtgccactgaactccagcctgggcgacagtgcaagacttccttccaaaaaaaaaaagttttctcttactttattattattgcatagttatggctttattcatttcttgccactttatttaaggtgatgttcaaaaatgtactcactgcagaagaataaaacaatagattaaaaatgagagaggaatctaagcaagaaaataaaagcaagttaaagaaatgtattctaaatctttttatgattaataaatatggtttttaaatttgactttaagcatcctaacagccaaggcaagaagtaaaacaacctcttacaaaaaaccaatggccgctatttacaaatttatgagatgctggacaggatagcttttaatagaactgaatagaataatatggtgaaaagaacatgtatcagaagttagaataacacaaataactgctagcatttgcatagcatctattatatcaaaacatttttatataaagttcacttagcctcacaattctgatgtatatagtttgattagtagtgttacaatttttaaagaaagaaagaacattaaagagaaggaagacaaggaaaaagaaagaatagaaaaagaaaaagtggaagaaaagaaagtaaaaagaaaagaataaagggagaaaagaaaaacagacttactggggctaaataactcactcagcaaaacagatgcattaagtaaaagaccaagaacgggtacctcggttttctttcttcagattccacattcttccttcagattccacagtgaccctcttgagagtgagggttctatctagttcttgtcactgacaccactgttgatttataatcatattaatatagcttattgaattgttacaattagcaatgtgtgcttgaatcagacacactatactcattatctctggtcttaacttcataatgtatgatcccattttatagttctggaaactaaggttcagagaggttgagtaaagggtccaagacatacagcttgttaagtagctgatcaggaatttaagcctaagatcttatatctagtatatggcagagagatattatttcattccaggtttgcttggcttcaaagcctatgtcctgctgctaatctgtagccttctcaccaaccaaccatatgacttggaacgagctgtttacgctcattcatttcagtgcccatgaccttcagatatgggataacgagctgtgctttatctgccatgaatgcggtcaaataaggagaggcatatggaagccattttggatactattatagttattttaagtacactaatcacactgtatattaagaacattaatacttgtaatttaatcaccaaactgataaaatatagaattatctaaaaataatggtataatttgcatatgttataggagatatctttggctcttctcatggtattctctgctttctggcctcacatcccttcagaggtgcaggcttgatacagcaaaagacagaaggcaggtgtttggcctggagccctcttaagagatacttgtgaaatgagtcttaactccatcttctgagaaaatgattcaaatcatcgagccaggcaaggattacatttgtaaattttgttaaccttgatatgaattgctactacctgggtctcttgtttccttagtaaccttcctcaataagcattcataggaaagtttcttataggaagtgttatagaaaggactcctgtgaaattcaccagactgaggagattgacttttatggctcagaggatgcagtaggcaaagttcctaatggccagtgaagttcctctttcagagaacacaaatccaaagtgaattctgcaaaatctaccactgtacttattccttcattgagaaaatggggtgctttatggataaatgcatggaaaagtcagacttcgaccaaagtcaaagggcaatagaaaccctttgcattctttctaatgacttcaacctgtggagtttggaaagttacagattcctctggagggtaacatatgtacaggcttttttccctatttctttataataaaaattgatgaagaggaatacgtaaagtgtggtttccctttaggcagagttcagtggaagtagcattatacatagaagaactttcagctaaacttagagagaaacagagacttttaggccaatcattttcctaaatgtcactgattttgtgggagtaagtaatagcatctttcctaggcgtttgttacagaaccacgtaaagagctctactatttgggagatatgcaaacctctaaaataatctaagctaattagaaaatatctgtagctgacaagaagctttgtatctctgacatcaaacagtgcctggaagaggtgtgttggttttcaccagcatgaataccagcagtggcagacaccttcttaccaagagagtaaactgatggacatacacagcctatgaaaaaattgacattgctgagacagcgctggggattaacctttacagctgtgagatgtcaagcaaaattgaaatccaaccattgtggagcatgttgaaatcagtgggtgtatacaaatctctaaattattactttggccagatggaaaaggttccatttactgcctgctggaggaggtttagtcggtaacactgaagagggaaggaagattgaaaatgaggtatttttcatgtgcactaaggctgctatccaagagtagcataagagaggatagtcacaggccaaatgggtgacatggttcacctcttggccccctactacaggtagccaaaataaatgactgtactttgaaataattgcctttagcagcacgtgtttactgtcttctgttattacaattgctaccctataatgtacttagacagcatttaacttgctatggtttcagacagtgacacaggtttaaggcttggctccaaaatgctgaaattgtacacaagtttaaggcttggccccaaaatgctaaaattgtatctgcaagaaagggtatggatgagaattgttgaaagctagtatatgctaattcacagaggagactgattattaaaattctctctccttctatcctaggtatttttcttctttttctacttggaaaactgttaatcatccctaaaatctcatgacacactcactctctctctgatgcattccccagctccagtaaacagttagttgctctatcttttgttttaattacaccactatcatcgcattttatgaggtttctgtttgtgtatctctcttcccaccttgaacccttcaacacagaaaccttatctttaacggagttcaatgtggttgttaataatgagctctgcaaggagaccatgtatgctcaaaccctgatttcacagctgtgtaaccttgggtgcaatccttaacataatctgtaagatgaggaaaatgggaatatccacttctttgaattattgtaaggattaaacaagataataaaatacaaagtgctttgaaaagcaccaagcaccaggctcagttaagtgtttgccattatttcatttttaatatcaccattgtctggcttaatatcaggcatagagtagacagactgtgcataaaaaaataagaaaagttccataacaaataaatacgtcaacagtgtttattttttgcatatttcttccttagttcttcagatagttaggatgaaatgaggagcacatatgataaaagcatgtgttccaggactgagtttgaatgcccccttgtcccaaattggagtgtcttcaataagcctccccttattttcttaaagtattttatagggagtcaaaagtatttgtaagcatgcttatgccctccagagtttttaaaaaagaattcaagcaagaagaggtggatatggttggccaggtttctattaaatgactttcttcagaagcattttgacaaaattaggcacagccaggaaagcagcaaaaaatctgtcgtttctcatttgctgaaaacgccattagctgcctcttctcgccttctgctcacggacacttggctcttgttcctgctctgccccctgtgcccagtctggcagataatgcaccagaaaatatttcacctcatgcacagggagtgggaactcacacaaggaagtttgcaaggaatggaaatctgtgcaaggcaatcccctcgtcctgagaaggaccccatttagcaggggcgaatatccattaaactctgatgaaaacatactcatgcattcaataaatatgcagcacctacaaagtgctggtgttttaggtgctaggaatccattagtgaaccagaaatgaaaacaacaactaaatggatgttaaacaaaatcagtctattagaaggtaatgaggtactattaagaaaaaagaaagggagtcagagggtcctgtaagaaggggcaagaggtgtgcagttttaaatggaaagattaaggaagtctctaataagacattggagactgatcatgagtaggaggcacttatatcagagtttttgcagtttcgaaaatgcattttgcactttggtgtaatttacttcacaaacaagggatgctcttaaatatttgcttatttaataactttctgaatactgagggatattttcctattgcttttccacttcataattaaatatgaatttcttggacaaaaacaaaaggcctaaggaaaaggaaaatagaacttaagagctcagtaaaaaatgtttattttttctatcttttcaaaaataatatgcaaggcaaatcacaaaatgtgaaagaacaaattacttttatttttggattacttaacaaacaaaaggaaaaaaaatctctggtaggtagctcaaataaagaaaacatcctgaattaaaaagctatctaactttatccagccaccatcctaatgttctatcacagatcatgcctctgtgcaaaaaggcctgatttctgagagtttaaaagaatcttatggttttgagaaatgaatacactgatctcttgcgaagaatgaaaaagccccaaaactcagcaaaggcaacaattcaaactaccacaggaaatgaaaaagagtgtgcatttggaacatacacagagttttaaaaaaaacaaaaggaaattgatatagataactcaatttccattagtgtttcataaatttaaattgccttgtgatcaactgagtgcttgtataaactacaaagcgctggtgtggtcccaagatgagaatgtaaaagtataaccagaaaaattaacataggaatcaattaccctgaaaattctgatctcagaggtccctggacagaaaacagtgctccctggaatgacatgaaaagaaatagacaaaatatccatatccacttctatataaagagatactaatgcactgtatacacaacttgggaatatctgcacatactttgattagaagtgagtttataatgaacaatgctcatgtgcattaactcataatactaacactttttactggagattatcaagaggtcagtgatagccaaagacaccttttctcccaccccttcagtttccatgactacgtatctttcctaaaccaccctggcatcacttgactcactttcttcctccttggggaggaatgacttttctgatgggtaaatttaggaaggataaatttcctgctgtgctcaatttctttcctgctttgctcaatttctcctctttgtccttctgggagcaaattgccaaagaagcagaattctccactgcttccaagcctaagtgtcccctgggcaggaccactctcccctacaccgtgaactggggatccatccccatcagcatcactcctgacacctaattgcacacagcgaattttgtgactgtcagcatcactcccgactgggaggctgagtctgcctaattgtggacctaacctgcaggttcttgtgcttcttgcactaaccaaagcctcccacctggcttccatcattaacagagaccttttcttctcgttgcccatgtttctgttttagtccttatttgtacagaactgagtaggggtaaaggtgatgttatttactggctctctctgagggaccctgatagtcagaacaagagatgttgtcaggtatacatacagacatcacagtactaacattgggcatggatggaagcattaaaaccaacaagccaggtttgtctatcccatttacttcaaaaacacaccttaaatttttacttattttatcattttgttcatttgaaagtaaattaaaaaacataaaaatgcacaccatcaaatgacatgttgcagtgctgaaaaatatgtgaagaaaaatgtatagatgagcgataacaggatttataactcagtgacaatctcagctttacgacatttaaattgtgaaatctctaaaagccctaaagtgttgttcaactcatgtcttatccatttcagtttggcttaccataaagtataaacatctagttagaatattttgacagaagaatattggtgagtcattcaatttctctaaccgtcactttgtctgtaaaatggggataaaaaattttttctcttaagttgcacaaaattgaaatgggagcatgatttccgaataggccagacatggtggctcacatctgtaatcccagcactttgggaggcgaggcaggcagatcacttgaggtgaggggttcgagaccagcctggccaatatgatgaaaccctgtctttactaaaaatacaaaaaaaaaaatgagctgggcatggtgacacacgcctgtagtcccagctgctggggagggtgaggcatgagaattccttgaacccgggaatcagaggttgcagtgagccgaaattgcaccactgcactccagcctgggcgacagagcgagactccgtctcaaaaaacaaaaaaaaaaacaacaaaaaaagaaagtataaataataaaataacacactattacaaatgatcatcccttttgtgaactattattattcctattatatgaacactttttttttaaaactcagggagtcatgtaactctgctatatgtatttcttcaagttaaataacaatgatttattaatgaactcctacatgctcttaggaaaggtgctatgtgtactatggattaaaaaaaaagtagtgcatgtttctcacattcaagaagcttttatttaagagaagaaatgcaataaacacagtagaaactaagtaaaaagaaattaggagagtggattttgtgcagtgaaagaggaggttaaaaaataagagggcactagacatgattttaaggataactgagctcagatggatgcaggagagcaggctggtgatttcaggggaggcgaataagtgggaaatattagacgagaatgagcatggtgagagcgctggagtagaggggcaagttgattctctactctctgtttaacagctctttgagctttgttatatttcatcaaggtaaaatatatatataaaaaaaaagatgggtgccaacctctccacatggtgtttggttagatgtggcaaaagtgtggtttttaaaatctatgtaaagaactccatgaatttccaacttattatactctaagtataaaaattgctgaatatcaatgattatacactacaaaagaattgccatttatgggctttattaatgttctagaacctataagtattttacatacttatttatacatgtgaggtcctcagcccttaagacaaccttgtgaaaattggttgctgttttacatagagaagcttgagtttcaggaaaatggaatcactcatgagagaacacagaatgtgtaaatggtggaacaagaattcaaacccacatctgacttagaggcttacccacgatgcagtcaacacctgaccatagtatccaatgacaggggtggaaattagattttgacatgaagttaaaaacacagttaaagtatgtggttcaaatatttaatcattctgggagcatcattctttatgggtgcaatccacattctctttagagaagaaggatattactgtggcaacattcaaagaaagtgcacttcagcctgaagctcagcaagatcgtcttttttgggggggaggtggtaattaactgagtgccctggccttcatccacttttctgatgatttccccagctactcagggttaagcttctgtcacaaaaattattctgagccatttgtttagcctgtttgatgttcactacatttattttccttaggcagcagcattgtgaatgttgactatatttaacatgcttagctgtaccagggaaataatcatctttggcttatttaaaatatccaattttcttagcctttgaagaaaatctagagctaatatggagtaattggtgatgagataggacagatccaagtgcaatttcaaggctcctaattttcacctacagagtaagatttctttattatgttagaaaatgttttggagagattttttcaattaggaggcacattaaacaaatactggctagtagtgtacgggttcaggaagaggggtaaatctcttagttgcttactttctttcaagaaaaactttaaatgattctatttaaccaaagagaagatggagagaaggcaacataagaatgtaattaagtttaacttttaaccttctgtttgggatttgcctctattctttcccaccatagttaagtgtgaagatagtcctcatccatatttagaagaagcctcaaaaagaagcaaaggaaggaaagaataaatagaagtattcactgtctatcctatattcctgccaatatctgggagtggcctcaaaataatacccttgctatctcagagcctatattgcttttgatacactagcagtacttctgtggttttcacggaacacataagccaagtccatgactgaagaccatggcaccataaggaaatctcaccactgacaccatttataatgaaacaaatgggttttctaagaggaggtaactcatggtataactgtcgtggtacaaggtctcaggccaggccttcccacttaaaaaatttccctccatttccaatcttagcaattttacaaagaaactggtcaactttccttaaataattattccaggacttaacttgtgccctaaagaatagacatattctggtctctctggagtgtggagaatgagaagatttgttttcatggaaaaatgtatctactcattttagacagccattggcaagaatagttcctattattgtaaaatgtgtgtatttgaaatatattagctaggcaggtcaactctgaactttacaaagattttgcaactatagaatttctttgctgattttgtgtttttccttaaatatagccataaatgctgagctatatgttagttttattgttgatgcattgtagaagagagatacaataatactgaggctaacttactattttgagctttaaacttttagtctaaaatctcatctgtgcaaattcttaatgaggtacattttcaaagagagctttagctatataacctctgttgtcatgaagaaatgcatttggctaatttcctctgtgtctccttgaaactttacaataacaggaaaaagttaactctgacttttcactcaagtaatgtttagaagtttctgctaattccaacctcaatgcaccagagatatttagggattgctgaatattgggaagatagatgtaggatttggatgtttgttcaggtgcctcagtcttctaattattttgtcattatgcattttcccctgtaatttgtttaaatttggaatcacatcaccaattacttcattgctgtctggtcttcaatattctcttgtttattcattagagaatttctgtgacaggccattaataactatgcatttgctgacgtataaagtcacatatccttaattatgttcaaatatctgtctggggaaagtacttgattctaaatgtactatcctgatcttactaatccaggtaccttagtgtatgtcttcacttaccatagagatttagaaaataaaaaaagaacacttagtactaaaagtaagactagcatagaaaaaacttgagctctaacttcagaagactgtggttgattccaattctactgattgctagttcataatgtagtcaagttacttagcaaatttgaagaaatttccttatctataaaaatggaaaatacctatggactatctcatgtgtaacagaactaagcttattataacttacaaaagataaatattcaaaatcagcataaagaaaattatgtttttggcaactctattcacaatgtttgggattcttcctacctatagttatgtatgaagaagtcacactaaagtaaccattagaaaatctgggttacaatactaggcacttttaatgagtgcttaccatttaatgagtactaggtatgtggcttgtctcaaaattattctgtgtctcagaagcactctgtgaagttggtattatgatgattttcatcttatgggcaggagaactgaggttcagacaggtttggtgatttgcacaggaccacagccagcagcatttctggaaaaatttgacctgtgtatcttcaaagctcagtgtgtcctaaccttagtaccattctgcttctacaactaagttctagtattaagtcataaaaggaccctgggcaactcattactttatcatgacctatatcttagggaagtttgaatgagctttcatgtcttcttgctcaaagtatgcatgattattggtcttaaacttcgtcacatgaacacaataccccacacatttacttgagatgaacatgggcctgcctcttatgaaagatattactctctcgacacaagaaatggaagaacattccatgctcatggataggaagaatcaatatcgtgaaaatggccatactgcccaaggtaatttgtagattcaatgcaatccccatcaagctaccaatgactttcttcacagaattggaaaaaactactttaaagttcatatggaaccaaaaaagagcctgcacagccaagacgatcctaagcaaaaacagcaaagctggaggcatcatgctacctgacttcaaactatactacaaggctacagtaaccaaaacagcatggtacttgtaccaaaacacatatatagaccaatgaaacagagcagaggcctcagaaataacaccgtatgtctacaaccatctgatctttgacaaacctgacagaaacaagcaatggggaagggattccctatttcacaaatggtgctggtaaaactggctagccatatgtagaaagctgaaactggatcccttccttacaccttatacaaaaattaactcaagatggattaaagacttaaatgtaagacctaaaaccgtaaaaaacctagaagaaaacctaggcaataccattcaggacataggcatgggcaaagacttcatgactaacacaccaaaagcaatggcaacaaaagccacaatagacaaatgggatctaattaaactaaagagtttctgtacagcaaaagaaactatcatcagagtgaacaggcaacctacagaacgggagaaaatttttgcaatctacccatctgacaaagggctaatatccagaatctagaaagaacttaaaaaaatttacaagaaaaaaacaaccccatcaaaaagtggtcaaaggatatgaacaaacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaacaacagatgctggagaggatgtggagaaataggaatgcttttacactgttggtgggagtgtaaattagctcaaccattgtggaagacaatgtggcgattcctcaaggatctagaaccagaaataccatttgacccaacgatcccattactaggtatatacccaaaggattataaatcatgctattataaagacacatgcacacatatgtttattgcagcactattcacaatagcaaagacttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactgtcacaagggcagaaaaccaaacactacatgttctcactcataggtgggagttgaacaatgagaacacatggacacagggtggggaacatcacacgctggggcctgtcaaggggtggggggctgggggagggatagtattaggataaatatctaacgtaaatgaccagttaatgggtgcagcaaaccagcatggcacatgtatacctacgtaacaaacctgcacgttgtacacatgtaccctagaacttaaagtataataaaaaataaaaataaaagtaaatagagatattactctctctactgcctccctgctatttaaattcatctaagtaaactacatctactactaagtcccaggaaatatttatttgaatatgcatagcaataattttatgcatgccaattttcctcctaaatacagacccaggaaatacttcatctggtacaaaagtatgttattttttctttccatgaataatctaatgtctgcttagtaccagacttgatggttaaaatggatgtgataattgagaaaactgttagcccttttcataaagggagtgcatctggattgacaacaagaaagaagaacaggaaaactagtttcaagctccagtgagaatttcatacttacagaaaattaaaattcctaatattggtttaaaagccattagcattccagccctaagacaaagtttcttggaatcaccaacacccactaacactgagcttgccaacatgtcattagggctcaccttccaagtgaatcctaatcaatagcctgtcctgacactgcagtgacccaaacccccggttactcctcacattacagtgggacaggtaaatttgtgtgtcccttttgacatgcaaatttgctgcgtgtgtgtttgtgtgtgtgtgtgtgtgtgtgaaaagacctgaaacagttcattctcttgtcccattaattccactctatgactccatcctaagaacataattctaaatatataaggaacttcacacacagataattcattacataattttccaaatactaaaaaaagaaattacttattctaaaatcaggattagtaaactatattacacacatttatagactataatataggtattaatttatgaaaaatctgtaatctaatgtaaaaatacttgtgctctaatactgaatttaaatctatataaaattttatagtaatacaatattattaagtttaagggatcagatatacatggagaaaaaaactgaaaataaacaaatgaaaatattatcagcagtttttttttttttgagacggattcttgctttgttccccaggctggagtgcagttgtgccatctctgctcactgcaagctctgcctcccgggttcactccattctcctgcctcagcctcccaagtagctgggactacaggcgcccgccaccacgcccggctaattttttgtatttttagtaaatacggggtttcaccgtgttagccaggatggtctcgatctcctgacctcgtgatccacccacctcggcctcccaaagtgctgggattacaggtgtgagccaccgcgcccggccagcggttattcttagaatggtgggactgggggtattttcttcatgtttctttcttttctatttatacattttcctcaatgattgtttattacctttgtagtagaaaatcatatacttccccaacactcaggtttcatttccaataattttcagtgctttgatgttttcaaatttaaatttagtttgtaatttatgaatgcgtgtatatataaaggcttacaaattgtgtttggttatacctcaactctatggttctcaatgagggttaggggagtgatctcacctaccctgcacccactggacatttggcagtgcctcgaaacacttttgcttgtcacaactcccagaaaggtgctactggcatttaattggtagagaccagggatgctgtcaatcaacctatagtgccgaagacagcacacaactcaaagaattatccagccccaagtgttcatagtgccaaggttgagaatccctgcctaaaacaaaatgtttaaaaattattaatatattaattcaagcctgttgtgcaaattctgagtagcctattgtattaccagagcctctgaataaacttgcctgtccatgatctacctaacagttcactcactcccacagggcattgaggatggaaagataagtgctctacatatgcggtgcttgaaatttagcaaaagagaaagacatagacatcaagtgtttaatgcagtttgaagtgctatgaaacgggcacttgatctaactaggtggttcaaaggaggctttctggaaaaaatacctcctaagctgagcttaaaggataagaaggagttaatcagaatcatgtgaacacctgagagatgtgttctagaaggaggagcattcatacttcaaagaaaggcatgaagatgaaacagtttagagtgtttggaaaatgatggggagtttgccagcactagagcataagataggcacagaagaaagggagaaggagccatagaagtttcagagccagagcctctttttttctgcctgagaaagtcaaagtatacttctcagtatggggatgagattgagatcagacaagtatgttgatttaaaaagcatgttgatttaaaaggacaagtatattgatttaaaaggacaatctattaaagatgcaattgaagaacccagtaatacagccatacctcaaagatcatgtgggttctgttccagaccactacaataagacaaatatcacaatcaagcaaaccatacttttttttttgttttcctgtgaatataaatgtttacacaatactgtagtctattaagtgtgcaatagcattatgtctaaaaaacaatgtgcaaactgtaatttaaaaatactttactgttaaaaattgataacaatcatgtttcttcagcaatcttgcaaaaagattagcaagtataatatttttgctggtagaactggccttaatgttgttggctgctgctgatcaaggtgatagttgctgaaggttggagtaattgtggcagtttcttaaaataagacaatgaaatttgcctcattgattgaactcttcctttcacaagagatttctctttagcatatgatgctgttgacagcattttatccatggtagaacttctttcaaaattagactcaatcctctcaaatcctgctgctgctttctcaaataagtttatgcagtattctaaattcttagctatcaattgaatgatgttcatagcctcttcaccaggagtcaattccatctcaagaaactgctttctttgtccatctagaagacactactcctcatttgttctagtttgatcatgagattccagtaattcagttaaatattcaggctccacttctaattctagttctcttgctatttccaccacatttacagttatttcttctaatgaattattgaacccctcaaaatcattcatgagagttgaagtcaactttttccaaactcctgttagtgttattttaacctccagtaatgaattgtggaagttcttaatggcatacagaatggtgaatcctttccagaaagttttcaatttatttcgtctagatctatcacaggaatcactctttatggcagctatagccttacaaaatgtatttcttaaataataagatgtgaaagtcaaaattactgcttgatgcaggggctgaagaatggatgttgtgttcagaggcataaaaacaacattaatctcctatacatctccattagaactcctggacaagcaggtgcattgtcactgagaactaatattttgaaaggaatctctttgtgaggagtaggtctcaagggtgggtttaaaactttcagcaaaccatgctataaacagatgtgttgtcattcaggctttgttgttccacttacagagcacaggcagaatagatttagtatagttttttttaaaagtagtgcggacccaaagagtgagcaacagcaagatttattgtgaagtgcaaagcaataaagcttccacagcatggaaaggggacccgagcaagttgcctgatttagcataatttttaagtcaggcaaaaagttgacttcaactctcatgaatgattttgaggggttcaataattcagtagagaaagtaactgcaaatgtgatggaaatagcaagataactagaattagaagtggagcctgagtatttaactgaactactacaatctcatgatcaaactagaacaaatgaggactaacttcttctagaagggcaaagaaagtggtttcttgagatggaatcgaatcctggtgaagtctaggttggaatggtaaatgagtactggcttcaacttaaaatcatcagctgcattagctgctaacaagagagtcagcgtgtcctttgaagctttaaagccagacactgacttctcctctctagctatgaaacttttagacaacatcttctcccaatagaaggttgtttcatccacattgaaaatctgtttagtgtactcactttagctagaccttctaggtaacttgctgtagctactccaatagcacttgctgcttcgctttgcactcttatgttatggagatgacttctttccttaaacctcatgagccaaactctgctagcttcagacttttcttctgtagcttccttacctctctcagccttcacagagataaagagagttagggccttgttctgggttaagttttgaattaagggaaggttgtggctggtttgatattctattcagatccctaaaactttctccatatcagcaataaggctgttttgctttctcattcttcacgtgttcagtgaagtagcacttttcctttgagaactatttctttgtgttcacaatttggctaactggcccaagaggcttagtgtttggccagtcttgactttcatcatgcgttcctcactaagcttaatactttctagcttttgatttcaagtgagagatgtatgactcttccctttacttgaacacttagaggccattgtaggattattaattggcctaatttcattattgttgtgtttcagggaataggccggccctgtggagagggtgagagactggggaatggccagtcagtggagcagtcagaatacacacaatatttatagattaagtttggaatcttacatggatgtagttcatggtgctcctaatctgaactcgattattcctgaggtatatggtataaaaatttctctagtaataccaaagatcactaaaatatatataataataacgaaaatgtttgaaataccgtaaaaaattccaaaatgtgatacaaagacacaaactgagcacatgctgttggaaaaatggcaccaaaaggcctgctcagcagggttgccacaagccttcgctttgtaaaaagcccattatctgcaaagcacaacaatgtgaagtgcaagaacacaaggtatctgtgttatgcctgtatcattgagcctgggtaacacactccttatagctctggacaccgtgaaaatacagggaaaattcaaactgtactaaggtacagtgttctctcttgttcagctggagagaaaatgaatgaacacaaattaagtaatttgagggacagtgcatcaggattcattattaagtgtgtttgctgtaccacgtacatcaggagtaactgaattcagattagaaagaaagggtggtataaaagagagggtgggtttcacttaaagctgaaatggaggaagggtggcacttgtataggagaaggagttctaggaataatataagccaggagtttgaaactgagatcaacatcaggtgttcttggaaatgctaaggtaggttttttcaattgccagtggttctcaaggctgcttgatgctcagtgctaaaagtgttgctcagatgcagctcaaagatcacctctttgagtccgttctgatgctctccactttctaaataggattggtcagtctttcttttatgtccctctaaaatctacatagacgtgaggcccaggcaatttactaaactaattttttggtatgttcatttatatataaacccaatgtagccaaaattatgtctttatgttctcaatgactagtacagttcttggtacacagatcacactcgaaaacctttctttcctggatgattgaatacatgattatgctaataataggtatgatgactatgcaaagcaaagacagcaatgatgttaacactgcaaataatacccaatatttattgagctctgtgtgataggcactgtgctaaggagaattttaacaagtatcatttcatttaaatttcaaaataatgtcatgaggtagctacgactagtactccattttacaaatgagagaactgaggttcaggtggttatatcttcaccaagatcacagccagtaaaaggaaaagctggaaatgaactctaggtctgtctcacttcaaagaccatgatcttatccactacttatagatcttttatttttaagagagtgtagacttaaggtgattttattttattttttaacatttgttcattgaatgtatgtgtcctagactcgaaaggctcaatgtagtgcaacagtctgaatagtaatgtaattttaaaaattaaaatgggtctttaacaaatctatgaaataagagtttgcaaactcaataaaaagagtatattatcaacttctctaagagacaataataccgaaaatgaaaaccaataggacagggcactcaggcattgactcattgtatgacaataccaggcagatggcttaatttatataacaactatctaagttggtccagcagtgtgaagttaggggaaaggaagtcattttattgaaaaaacgcatgtgttaattcaaatcacttgacagtttggcagacaattccaccaaccgcctaaaaagagactagacccccatcccctcaatagtacagaagggatagaaaaacctagttaaatttccaaaaaacaataagtcatcaacctgagacccccttctcaatggttccctttattgccaactctagaacaagggctggcaaaatacagtggtaggccaaatctagtctattctcaattttggtatcacctgccagctaaacattgtttcacatgtaaaataatggttaaaagggcagacattaaataaatatattgtgacatatgaaaattgtatgggattcaaagagcatctacaatgttttattagaacatggccacacctatctgtttgcatattatctacggctgcttttgtgctacaacagagttgaggagttgtgacagactgcatggcccacaaaacccaaaatgtttactactgaaaaagctggctggccactgcttgagaatcaagctcagcaggtgtcagacaacttggcacagaacacactgcagataccatgggtttggcctttccaacttattacctaactcaatggttctcaaagtttggcccctggaccagcagcatgatcctcaagtaagaacccattagaaatgtgaattatgaccccaaccccagatttactgaattggaaactccatgggttgggcccaacaatctgtgtctaacaggtcagctaggtgattctgaagcattcttcagagaacggtagtcaaactcaagaaactggaacatggcaactgttgtttcaacacaattacaagaaaggcacttattggctcctatttgtggatgaagaatggagctagatattccacttatattttagtattcctacaataatcttcaaagattgggattattaaccccattatatggaaaaggaaattgaagcttgggaagattaagtaacttgttcacagttagtgaattaggacttcaactcaaatctgtctgctttatagcctatactcttccctctcgccttattctgccttctcccttattatgtgagagaaggagaaaagcacctgtgggcccctggaaggagctgagctgatttattagttaggtcttggtgttttcttgatgattataaaccatttcatagaatatgaacatcagaaaacaccactgtggacccatggttgatcaatataacaacaagagcactctataatcatgtttgaacagaagcaaaaagatgaactttttctcttttttttgagatggagttttgctcttgttgcccaggctggagtgcagtggtgtgatcttggatcactgtatcctccacctcctgggttcaagcgattctcccacctcagcctcccgagtagctgggattacaggcatgcaccaccacgcctggctaattttgtatttttagtagagatgaagtttctccatgttggtcaggctggtctcaaactcctgacctcaggtgatccacacacctcggtctcccaaggtgctgggattataggtgtgagccactgcgcctggccaaacatgaactttaaaccacaaaataatcaaatacctcctatcccagctaatatgagtaacagctgcttctttacctattacagcttttgtctctgtctagtcttcactacttgcagacacaagttacccaatcacagcatgactctggcttcttgacagcttcctgtccaggtcaatgtcttgctcacttaaaccttctccaaaggcaccaaaatgagctcaaaccctgtaataagtcctaacactctctgagacattccccgtttctctgcagcatgtattctctctctctgcaatgaataataaatgaaaattattcaaccacaggtgtgtttcctgatgatatttggctggagggcattccccttccactcccctcactgcccacttaaaattatagctctcctcttccagcctgggtgaggcacaagttaccaaagtaagtaaaaataattagaactggaaaataatagtccccagactaatcagtatcaagcacattgccaggtccaagcagaaacttggtattttaaataattaatgaaattttcagtgccaatctgattacaaaaatgatttcaggaaactgcctgtcttttaaaaatatagttcaattttctgcttttagtttctagtctctacctgtcaaagttttggatctctcaactcttgagatgtaaaatgtcacttatctttttgcagccttccccaaaatcttctagatggctcctctctttgagttttctaaaggccttactccctctcacaatactttttcatcttggattagttattcatgagctgtctggcctctaaccaattcggaaatttcttgaaggcagtaaaacacctgactatcctcccttcccttccacacagtaatacatatttgttatattttggcaataaatctaaacgtttttccagttacagaattgaaagtgttgcttttccatcaaaccagagctcatataagcggggactctgcaactcattgttggttatcttaattgaaattatctccctggctcaggagttctaacaaacatatgtgtttggtgtgcaggtatcttcactttgccaggggattttgatgtgaaatattactaacagaaaaaatatatatataacaaaaatcttaatcaatgaatcaacagtttttaggctactatggaaacctgaaagtgatactggaagttacttattatgtgggataaatagatatgaactggcactattcctgtatgaaagcaaatggcattcaggtcataattttcttcagtaacttctatttaccaagcactgtgctaaacagcaaggataactgtacaattaaggagaaggagtaaaacagtcaactcctatcctacattttatcgttgttccaggaatttcacgtggtgtatcatggccctgtgcttgtacatggtgttacctcacccagcgttttacatacagtacttggataagcaccattcttatatatcaatcttatacacttctcttcatccataaaagccaggattagaggtcacctccaccatggagtcatctctgattgctttcatctcctctacttggacttaattacctaacattcttcttggattttcttgtactggtctatttaccatgatgtattatattttttatttgttagtattctttttcttcttatgcaactgagaatatcttgaaggcagcaactatctttaattgatctctatattctggagcctagcctagtgcctgacatcctgtagacaatcaataaatatttattaaatgcaagccatgtgaaaacaagtgccaaagtactggtaattattaaagttagataatgaatatatgacaattcattacacttttttctataccttgttttatgtgtaaaatttttcaaaataaaaagtttacaataatcgaggaccttgtaagatagcggattaatctatccaaagttttaagttccttccactatacctatagctatgatctctgcgtactccacatttctttcttttctcataaaaaagatatttaataaagccaaacaaagttgctctgaaataaagtataagtatattgtttccaaagagcttcatgtcatggatatcattaaataagaacttctggaaaaactggaaacggacagttctccccaagtattttattgaggagggaattctgtggatttttgtccttccaatctgccatctgaattgctacaaaagcataactagtatctctgcttccactttctttctttttttttttttttttgagatggagtctcactctgtcgcccaggctggagtgcagtggcgagatctcggctcactgcaagctccgcctcccgggttcacgccactctcctgcctcagcctcccgagtagctgggactaccggcgcccgccacctcgcccagctatttttttgtatttttagtagagacagggtttcaccgtgttattcaggatggtctccatctcctgacctcgtgatccacccgcctcggcctcccaaagtgctgggattacaggtgtgagccaccgcgcctggctctgcttgcactttcttacctgtgaactcatcttcacctacccccaggttgacctacctaaaacatggatctgtcccacttgctcccccaaagttgaagtctttaagtcaatggctcttcaatgtttagggaataagtgtgcacttctagtgttgaaccccaagtaacttgtccagccacatattttaatgttcttagacccatgtgcaacgagccatatccaattcacggtcctaatccatgcaagccacccactgtctgtgcttagattcacagctcaatttccttgctcagcttggaatcttcttcctggattttccaatttgggaaacattctcccactccaaggtcctgtacgactagtttttcttctccattaaaccttctctggagtcctttccagaatgaacctttctacctgtgcttctactggccatggcctgggcctatgcccagcattattttctgctgccttgtttagtaagtagtctcctttaccagaatgtaagcttgttgagggcactttaatgttcatcttgcactttcccaccctctcagtcaatacccaacagggtaccctgcacacgttagaattcaatatgacaagattacaaactaaagtatgaaatgatgagcttaatctcatgagtgttctttctccttccgcttactaataagtggatatgtgcaaaatttcaaatccctatagtaaaatcacactggttgttttgatcttctttacaaattgcttttgagtcctaagtcatgaatttcaattaaaactttttttaaaacaagactatcgaaattggaaactaaaacaaataactgtttctcttaacccttttctatctgtgtctaattctagtcaacattagagatgaaaatattaaggcaatactgctttatctcaacattaatatgggccctctcattcaaatagactcagaagtactttctaatgtattatacagaaaatcacactggagaaaatattccatgatggtaccattgaggtatcactgcttcctgaggacaacatgtaagctcaatgctgcctaaaagaagctcaaatttctactctgggccttttcaccttcacttctccaccataaaaaaaaaaaaaagaggctaattctctggactattgtgggtcatattttctaggtggtgcaatcttagtgaagagtttagcaatttgcattgggataaccctgtcaaccttcatcattttcagctagaaagaatgaaagctctgataatctaattttttatggtggtttgcactttagctgcctttttttctcaaacctttacttgactactgatcaaaaagtccaggttctgtttctgcttagacaatgtcatagtctaaataaacaggcagcaggcctaggatagaggtgtcaccttctcattggacttcatcctcagactctgcttgaactggacattcatcatgattgaatgtaagtcacatttggtcaaaattcagtgcagatcttagatgtctgacaggggctgaggagaccacttggcttgcttttgtcctaatcttgcctctaatctatgacaaacatcagtggtctggcttagctcatttatatcccatgcttgggtcccattcctgggttgaggtcagagccttgtagaaattacatgcccattatatgattttcttttaaatgcatttgccgaaaatatttcacatggtattagccaattcaggaaaagactcaagaattccagaaaattcccatgtgcattttcatttattccctttctcaacattaaggaagatgtataaaagtatgttgtagtaggaaaagcactgtgtaggattcagtagtctttggttttgatcctgcttctgctcgcagttacatttgccttatgacaagtcagttaactttactggattgtagttgtctcctatgcaaaataagagttggcccaaactagtatttcctaacatgtatttcagaggaaaaagggactgactcaacaagtatatgtgggtcttccctcatgtatggtgataacctgcatccttgtattttaacatgatcatggattctatattgaattaaaagtttctccagcttactgaacatttcacataatatctataaatatttatgtacatctctatgtgtatgtttgtgtgtgtagatatagaaatatagattcagatatggataggaatatgatttagatatctctcccaaggaagacttttcagaccaactcaaaatttctatgattctagttgggggagtcaggtttacaattctaattttcattttgttgaaactcaaattcgaagtttgaatctgcaaaccttcaactttaagtgatatgaaacagacattgaagaataaaagctgaatcgttgcccggggccttacacttgggacttttgattttaaatttctacattattaactttgacaatataagaactgtgcgctatcctcataatgctgtgaaagttgacttcctcaatacatttgtggaggttgtcctttagaacctaactctgaaaccaagtcagctccagtacaatgcactgaagttgggggctgtggctcaactaagtccagagaaccaaaacgtggtgacaaaacagaagcaaattattccaatcatagaaattgaaattgctagtactgtattaagacaccagcatttagtgcattgaggcagaaatctcaagagaatgcaaaattgtgtaacattggagaaacctgcttatgcattgatttccttcaggggttaaataaaattactgtgaaatataagaaaaggaaaaagaactaaattctgaggttttaatcccattacagtattatttgtattgtgtctaagcagaacttattgagaataaagaagatacgaagattacaatagaatgtatgttcttatattgtctaaacagttagaacctaatgaacttactttgtagaataaaaggactttctgaagataagatacattggccatcattaacatattaagagaaacaacctgtataccggatcttgtttgggatgatgtcatcatagctatcaggtcttagctcctatagttagaaagattacagaaagcataggcaagtttaaatatttccatctccccacattaaacacaatgtgagaggtaaatattcattacttggcaataaaatatcatatccatatctggaagaaatattagcaagtatctcatggacgtcattctttcacttaggaagaaagaggagattgcatgtagaattgatatcaaatgatttaggtttaaatgattcaaaggctattattttagtaaaagcattatttcataaacaatatgtgtgtgtgtttgatacatacatatacattcaaatagttaaagcaaagttaattaacttcttaaaactctccaatctttgaataacaaaactcattttggatagcaagagtaaaatttatgttagatggatctaatttttattgatagcaacagtcctgtctcgtgtgtatgagttcctactcaggacacacatgagcaatgagactcactggggaatgcaaatgaaacacttgcaaatcaaatgttcaaagcacatttttgctgagcacccattaactcaatttcatatcaaaagcttacccattttatatcataataaaccacccgggttcacccccacacctcctaactaatgagggacacacagatattctcttcacaaatcaagatactctttcataggatgaaatcactaatgacattaaggtgtggtaaccaacatgaacttgacaaccaaataccaacccatattatcaccccataggagagagtcctaactccccaccttagaaaaatatttaacccacaaaatactaaacccaagtagatttcaaatagaaagataatggtacaatatcccttcccttctaatatcaaatatctagataaaccaaaatgaactgtccagccactaggatgctctatgccaaacatgcatattttaaaacttttactttgagtattaaggcttcttaacttctgcagcatctgtatctacttctaaaccagacctgcccaacagcacagactggagcgaccactttaccttccgaaaaatcaatcagtcccagcaaatgaagaagcttcagagatgcacatataatcacaacaatacccactgtttgcagtccttcggactcccactccagagtcaacatcctctgagctggcagagcatcccagcctccagacccctttggagtggagggagttaattacagaatcgtagcaacgtcaggcttggaacaaagacttgcaaggggaaaaagtgagcagctcctggcagatgcaccctgcaaagccggcggccccccggggtgaggacagacctgggctaaagtccagcttctcatgctgatcctggcatttggctggcggggcttcccccctgctaccacagcgcacggacctctccactctatgctgcagccagcgggcgagtacttcgacttcagagctgcgagggaaacgtctgtcggagaactggagactttgcagtgtccgtggcgagaagggacactcctaggaaacttgcccgggagaacaccgcgcgcttccctcgctgaggacgcgaggctgggcagatctgtctgcgcgctagttttctgcctgagaagcttgcgaatggcccctttttgccaaagctgctgctctctcctcccagagccgcctctggcagagagctcagctccctctctgaatgctaggaaacaatcagttctggtggctggtgcctacaggcccttcctgaaagcccccgtggaagtctagaggcagcttttccagggagaaaagtgcaggagcaaagctccgtgattcaatgactttgtcaaacgagaacacctgagcctcccccgccacgccactccttgttctggtctccgctgtcacgtcgggcgcattatcagggagattgatttagtccttatattatatttacaaaggtggacggagggcgtggcggagcagtacccggtaacaactaagatgttcataactgccccctggaaggtgtgtaccaccatcgtcctttaaagtctggcctcagcctttctcaaagtttcacaaacttccctgatgataaaaacaacctggggttgtttattaaaaccacgctcatcagaggagcctggagtgtgtgttattaagaagcccaggtgactcttatcaactgggaagtgtggacagcaccatcgcaaagatgccatgaggtgtgctagtccaaaccactccaaacagaccctgttctgtgccaggaccacactggctgaatcactttgttggttatctccagtctactgaagcccaacctaaaaacggagatgaagagaatcaacagggactctgtaggtgaactggaaatataagggtttgtgagtaatatctcagacctccagggtcatttgcaagttctgcttctttcttgctatgtgatcttgtgcaagacacttaaccactctaataacaggtcctattctatgcagtcaagatcataatacttcatttaaagttctccatttaaagggaattatgggaattaaatgtgatcacaataatagttaacatgtactaagcacttactatgtgctcatcaatattgtagtgacttttcaacaacttacttatccctacatctctacgtggtagacaaattaatctaccacataagtggcagattataagttaattctaatcattttaactttgtaggtgaggaaaacaaagcatgaagaggttaactgacttgccaagcagtgggcatagtgactggaaggcaacaggctttcattcattcagttattcattagcatttattaagctgctactatgagctataaatggtacatgaatgatcaaatgatgaataatactcagctctgtcttttgggggcttatagtttaatgaggaggcaggcatgaagtaaaatgtgaccaataaatacaccaacacttgaacagatgtctgcgcggtacagtgggaaaacaaggagggaaagtcaactctaattgggaaagggtttagtggtatcaggaaggagactttatagaggcggtaactgtccataatggtaacctgaatcattactagaagtattatagtataccatgctcaagttttgaggttggtagacctgggtacaatcctagccttacccttgcttgctccatgaccttgaagaatacactccgtctctgaatcttggtttaaaatgggaatgctactgcccctttctcatggttgatgtaagaattaactaagtctgcggggagctgagcccagtccctggggtcccctgctcacatatggtagttgtggggttatgacggaagttccaactcttcagaggctctgcaaggtctccttggatgaaacgactttgcttttccctggtcctgccacccctgctccaaggtctagtttcagcgtttttcccatgaagacctgctgatcatctcaacccacagtgtggtttctttcccttgagtcctagaaataagttggtcctgccaaaggtgcttttcattttgaataacatatttataagagatatccttgtatccacctgcccaatcacccatccatccaaacattttcttctccattatatcagcaagcctgtggcggggaagcaggttttagtaattagtaggaaaaaaaatattttaggtaaccattttctgaaatttccaccaacgtttagctacagaaagtcaaaagttaaaaaaaaattacagaaattaattaggtcaagttaaatgtaaacatgtcttttaatcctatatcataccatattgtagttgaaaacaactaaagtactgagagggggtcacatggttagaaaacccagaattcaatcattgctttgtctggcttccaaattcacgcttttccctttatttctatcagcagatttcagcaaatatttgccaattgatctcttagtttagagagttggtaaagtattttaaaattgccacatctcattttccaggattgaaattcctatcttttttgaaattcacataaagtcccatgaatatgattttgttggtttcagatagaatttcccttcaggacaatagcattctctacttagaatgtgccagctgattggaggtccagccctttcctatctgcattagttacatttaccacatgctttctgagctgtctctcagctgtggctaccggatcgaatctgctggctcccaagtatgcgggggctctttcacatgcacccccagctgtgagattttgtaaggtgacagcaccataagaggagtttcctgcttcatctaaaaagtctagggaagcaggggacatctggggaatgatgtttatctagcgccactcttggaaagaagagttgcctgcatagcgctttgggaggcttaggtgggaggataacttaggagtttgagaccagtctggggaacatagtgagactctacctctatttttaatgtttaaaaatttaaaaaagtaactccagatcacggctcaaccattttactgcagtaacttgctagccccaacccagtttgttatattaaaacatcctggctttctccctcattcactgactcacccctttctttacattgtaatgagtcctccagcagaggtctgtctttcataccaaagaagggaataccaaaggtacactaaaggcttttacccattgattctaagccaggcaccatactatgtagtttacatgtataaattagtttcagctcaccccaaatcaataggttaggtgttattatcactatttcaaagaagaataaaaactaaggcgcattgggattaattaattttcacaaaattacattcaacaagggacataaccaggatttatacctgatttactccaaaaatagtagctaccaacatttatggagaacttttaagtgtcaggcactactctaaaatatttatagatattggccgggcgcggtggctcatgcctgtaatcccagcattttgggaggccgaggcaggcggatcacgaggtcaggagattgagaccatactggctaacacggtgaaaccccgtctctactaaaaatccaaaaaaaattagccgggcgtggtggtgggcgcctgtagtcccagctattcgggaggctgaggcaggagtacctcgtgaacccgggagacggagcttgcagtgagccgagatcgcaccactgcactccagcctgggcgacacggcgagattccatctcaaaaaaaaaaaaaaaaaaaaaattatagatattaactaatttaatccttttatagttccctgaaataatttggtttcaaggagaaaattcaggctttcaaaggttaatccacttgcctgaagcctcatatatggcacttggtagaactgggatttgaatgtgggtatactcggtaccaggttctgcctactttatcattcaccacctcactctcaggcccctctgcaccatgttgaatggttctttaactggggccgtttaactggttgagagactctgaaaggaaagtattgacagaaactcttaggaaagtaaaaactcactccaaggacgcatgtccaaatcaattgaccagtctgtgaaagagagagggtcagtagactttacatttccttgccccaatccattgtgatcctttaaataatctcaaatgggatgatttatctaaaacctgaaattgatcatttttccttgttttttatagcttcagtttgaaatttcaccacgtgatagtctcggttaagaaatattcttcatactgtttgttgacattataataaatgcaaaaataagtgtagcaagattgagaaaaacgttaaaattcgatatatttacaatctacctgttctctcttcaaatacatagaatcacaatgtatatagaaactagttaagtcaaatttaaatgtaagattattagcctatgaagggaatcagaaaatgttactccaaaatatgtcctttggcataagggttattttcgattgaaggcaactgaaataggagactcaggaaaaactctctaccttccccctctctgcctcaaggcaggggatagatgtatgaatttctctttgtaaagtattcccttctgctctcctgtatgagaaggatgaaacaactataatcactgggcagaaagtcggcaccagtgggatttgtgtaagaaaccttacaaataagccttatattccattagtttcccctgtatatttttcttcccacaatttaccaccctagaagcccaaatccttttttctttgtcttgtcacttcacaatttatcaccctttgttaggatgattatataagtccccaattctaagcacccctttgagttactcttcattgagttctcacatgtatatgtgctctgcacgtgtaaataaactctattaatctatttttcccatcaatctgtcctttgtcagtttaatttacagggtccaactactaaatctaagaaggaacagagaaagtttttttcacccctacatccatattcatacaatcttttaggaatcatttaaagataaaataatatattttttaaaaatttgcaaatgcataaaaaggaggtatagagagcagagttggcttgtttaaggtcagggacttggaagtggacacaggtggctttgaatcctctagcttttcataatccttgacttgcttagtataggaaaaatcaggatgatacactgaaaagttaaaaagaagtaaaattctagaaggaaaatttcttctctcagtcaatagaagctaagagaagcaagccatcaggatggttggcattatccggaaggttgcattgaagagagaaacctaatctaggtcattgaaaatgagtttggagaggagcagtgactttcccaggaacataaatgggcacacacaaagacagcattggccaggcactgtgactcatgcctgtaatcctagcactttgggaggttgaggtgggtagatcgcttgagttcacaagttcaagaccagcccgggcaacatggagaaaccctatctctacaaaaattgcaaaagttagctcggcatggtgacatgggcctgtagtctcagctacttggggagctgaggtgggaggattgcttgaacctaagaggcagaggctgcccgtgccactgcactccagcctgggcaacagaatgagaccctgtctcaaaaacaaaacaaaaacaaaacaaaagacagcattcacgacagtggtaaagccagattgagacctccaagccaggcgagaaaaatgagattggatagttggtgaaagatgccacttaacatcaggacttgatggggcaagtaacaaagacaaggtcagtgtatgacccttcatgtctcttcacactgtaagattttctcaccaaaatgatgaaagttatctacccgcaggtgccctctactctaccctcaacatcacctccacattaaagtatatcaagcctttctatcttggggtttctcaattactttgaaaattcctaaatgttctccagatgaactttctgctcaaacatgatcagactcaagcagtttcacttagctgaaggctcattctgaaaggttagtaaatgtgtcttgaatggacttctttaaaatatgtatatggatgtccattaaactattaagtaccacagccttctgttttgaatgccctattgaatccacaaggtcgattggattttcaaatagaaagctgagggaaaaaactaccttccatcctaagacacttccagcaatattgcactaatgtatcttgaaaatagtcctcatgaatcttatgatcaaagcatgtatagtatgtaatcttcacataaacaaatgagtagactatttggaagtccaaccagaaaacttgcattagaatataagctttccttagtaggatttatgacatttttgccataatttctttttcccagcctttgtggcctaacctgaatgagttcctgggtttacccatttaatccagtatgcaatttgtggctctcctgtcatatcccttttgatgtaatctctctgtaataggtgtctgtcacatcccaccacactgggctggctttaaggccgtgattctccaggataataatgatcattatcccttttatatattatagtttgtagtacaataatactgaattcctaccacgtgacacacagtgtgctgtgtgcattacataaactgtctcattgagttgtcgcaatatctcaatagaataactaatcattaaccccattatatagatcagaatgctgagatgcaaaagcttaagtaacttgcccaaaactacagtgttagcagttgaggagctgggacttgacttcaagaattctcactcaagagccagggttcttacattggaggggaagtatgtgtcaaagtcatcatttttgttttgttttattttattttttactgtggccccattacacaaagagacacaagatttaaaatgcgaatgaccttcagaaaagtaggatgtgacgttaacctcatagtgaagtgtaaatattcagtaactagttctttcctgggaacaaggttaagagagcaatgaaaacacaaatgagatgagggaaggagctcgggatagaggtgagaggaaggagaaaagatgaagggaagggagaagagaggaagaaaagggaaagcgagaaatgagaaagagaagaaacaggcaattctttactccaggcactgagaaatctgaggatacatagatgaatggggcctgtgttctgtttgtgagattctcatagatggccagggagacgtgatctaaaatgaataaaagagggctccaggaaagggccgatcaaggggctatttctccttcaattaatcctacctccgtggtccaccagtctatgcgtctcttataactagaaatacagaatatctcatcagcttcattttctcagccacagcttcagatgaccttggaaatggaacaagtggttttaaaagtatgacaaatggcatctccatggatgttgtagccatggctggggcttggtcctacttctaggtctgttcctaggccctgtcataccttcctgctcatttgggccagggccttgctgccatagatataccacttcatcagcttgatcctcccagttcttgggcacgagattccagagactgacttgggtgtcctcagagctgcgtaagctcatttcttgcaccacaacagtacttgggaaacagaacccagcaggctttggcttaaatgctttccaattctgaagagaaactgaatgaatatttttagcatattttgttgtataggagttgtagagactgtgttagtccgttctcatactactatgaagaaatactcgagactgggtaatttatgaaggaaagaggtttacttgactcacacttcctcattgctggggaaattcccatggcctcaggaaatttacaattatggcagagggcaaaggagaagcaggcactttcttcacagggtggcaggatggagtgggtgcaagcaggggaaatgtccgtcacttgtaaaaccatcacatttcatgagaactcactcattatcatgagaacagcatgggggaaaccacttctatgatccaattacctccacctggtcccgcccttgacatgtggggattatggaaattatggggattacaattcaagatgagattttgggtgggaacacagccaaaccatatcaagattatatggaaagaatatttcatatagttcccaaaactctcctccccaaataattccatgtgctttctcctgtctccctccctttctgcctctcccccaccccacatacaattatcacccggatcggatcattttccttatctatgagattagaatgggtgaagtctcaatgacttggaaatccccttttcaccaaccttagagccctgaacattctcaatggatgatgaacaaagaaagcacagagtaggccgaacatggtggctcatgcctgtaatcccagcaatttggggggccaaggcaggtggatcatctgaagtcagtagttcaagaccagcctggccaacatagtgaaaccctgtctctactaaaaatacaaaaatcagccgggcgcggcggtgggcacctgtaatcccagctactctggaggctgaggcaggagaatcacttgaacctggggagtggaggttgcagtgagccgagatcatgccactgcactccagcacaggcgacagagtgagactccatctcaaaaaaaaaaaaaaaaaaaaaaaagagagcacagaataaatgtttagagaatgcctaccagaatgcagggcatgggtcatggtaggccttcactctctaagggctacctatctgaggtcatggcacaggactgggagccagacatgtagcctggtttttggaccattagtccagttctctttccactgcaacagggtatgaagatgtctatataatagctaagttacaagcaaaaagggaatatgcactatagaagagatttcttatagtgagaagatcaggaaaatcccagagaaagagaagacatatgaactggtcatgaaggccaggattaatatgacctgtgtccatattactgttcatgaatgcaaactcttgctagtgctccctaaatcagaagcatctatgaatagcttccaagattcattgtaacccagcaatcagtgaagctaggggtcacatcccaatgaatcactttgacaaaagggactaagccctcttaaaagaagtagaggaagaagaaaagtttcccctacctcagcttcaaatacagaggcccagagaactggaaacaaaatcattcttctgggaatgagttttcctagaactcacagtcagtgttgcagcttatgtgcctgagattgcttattttctgttattgtacccattactataatgctgaaatcagtttgtatttgtttcccgttgctgctatagtaaattaccacaagcctggtggctaaaactgacacaaatttattatgttacggttctggaagtcagaagtttgaaatggttctcattgggcttaaatcaaggtgttggcaggaccacgttcctattggaggatctaggagggaatcaattttcttgccttttccagcttctagaggctgcctgcatatcttggcttgtggccccttccattgttagtgccagcaatgaccatttgagtctttctcacattccattgctctgacactgacccatctacctccctctttcttttatccttgtgattacattgggcccacctaaataatccaccatacaattcttattttaaggacatctgatgagcaaccttaatttcattcacaatactgattaccttgtgtcacataacccaaaataacacaaatttactatttcacaattcctgggtttaggatatggccatctttggggtttttattctgcctactatatagatgtaatatattagttatttttaacaggaaacactctttaagaagaaaaaagataacataaactgaagctcacgaagacagagtccactttattaggaacaaactagttgaggtaagtgcatgtgagtgtgagaatgagtgtgtgtgttttatttttaacatacagaaaaagaactttgtctttgagaaggaaagggcagctttaattagcattcctatttctgaactaattgtcacagagaaaggactttgaggaaagtacatttcaaaatattaaaaagggaacactaaacaatttagagtgtataaactaatgatcagaccgagggacactctcctttcattttaggtgcaagcccagacatgaactaggagttacagggatagaaccctacagtacccagaactgggatgtgttcttcccacaaagaatgtcctagaggattacaaaagaaaagagaggagaaactactgcataagtagagaaaggcattcgcatgttatcagtcccatcagctaattcagccttcttaggatggataaaaccaaaaatgaactaaactcttcagctactgagtttttcatttttagttcaagtgtgcaatgctctgaacatgagaaagccatagagcatgactttcaaagacatggtagcaattaaactctaggaaatggggggctttatcctttgaagagccataagacactttctcctaacactgcctttaaatgtgcttgcatcttatacatttcagttaaaaatcagctctaaccccttctgaatgtctacttttattcatgattttcctggagtaagtttacctatatttacacttttccaggctttctctcacttgttctttaccgtaggctattttaaaatgagaaaactgagactaaaaaggtttgcatgatctgaaatcaaaaatggctgcaaaacagggttaaaaacaggcattctggctccatgccaattttagattttttttcttttctagtcttatagagatctttttctctgttgggtgctgtgggaagtgctttatatcagcgacttataaaatggggataataaaagcatctatctcacagtgctgtcaggggcaatgaatgcgttaatgtagttaaagcattcattgcaggcacaaagcaaacactctgtttctaaaagtaattatttttttagtagccatctctgaggtatttcgattattatgcccatttgaccaataaactgtgatccagaatggttaagacacttgttacaaagctggtaagtgaagctggaactcagtcctgctatgagaacccgttcccatttgcacaagccacactcacattgcctctctggtttcaaagaaccactctcagtcactcagctagttcttggcttccaagcaaggcagagcctaaactaactgagctgtattattatacttcatctgtttgacaagatcctcagatttcgatgccatcgctcagtaatctcttctttatctgaggactttgacctttgcataatttccacctcactgcatttgtgcaaaaaaatgttgacaccggttatgtaccatgcaaaatatgcaagggactgtggggcatgaagggtgtgaggaagcttacagcccagaagaaaagggaaggaatgcacataagttactaagtccaaggaaaaacattagtgtccatgagaaaatgcgtttaaagtgtggtaggatttcaggggcaggagaggagtaagaaagtggaagggtgatgttagtcagggagtgttgcatggagtctgagcttgaccatgagtggcagctcaatcattcctttaatgagtcaattaacaacacttatgtctgctatatgctagaatatgcaagaccctaaacaaatccaatcaacaaatcccattggttccacctccaaagtacattctgtatctgaccaattctcactaaccctgctaacatagccgtaggcccaagccaccactcagcaaactcctgtctaattttgttactttcgctctcacacccctaaggtctatttttacacagcagccagattaaagagcatatctttcatataatttccctgcttacagtccctcaatagctgtccattatattcgggataacattcaaacttctcgctgtgttttgagtcctcttggatctcaattcagaccaatgtaatcctgtcccacacctcctcatcacagttctctgcccacatagtctttcgatttattaaataaactaagactatccctgccactggtctttgtactttgtgatccccatgtgatgttctttaccccaagattgtccccttatttcttagactgtctccttattcttttctctttcttgccactcacttctaggctcaaatgctgtcttctcagagaggcctttcctgaccacactatcagaaggattctgtgtttttgtcaccactccctggttcctcttgatcaaattgctgtttttttatttaattttctccgtagcactcaccaacctccctgaacttcttttttttaaatgcctcttagcacgttcatttcctatctcatcccacttgtgtagatgctcctcacatgtgggccctttaccgacctcattcatctcactgtctccaggaactaggagagagattgtcagttacaggctttctataatgatttgttgaatgaatgatggcataagacagggttctttcctcacgcaggcatttgaatctcatgaagtgcatcagcaaaatcataatcagagactggcaagtaattttattaagtagtgcagtgggttcaagggagaattcattagactaggatggggggaaaactacgaagacctgcaaatatctataagagagtggaatgaggaagatttaatgatcatttcaggcagttgacaggcatgatcatggcagtatctggtccgtttcatctggtaatagcgcaaataaaagcaaccacaaccatgaaagaaaagagaaaggaaacaagagacaggaaaaccagtgagtaggctgttgtaatggtctataccagatgtcctatcagtgggcagaaagggactggacacagaaaccagcaaagctgcaaagctgaacccagcagagcatggtagcgtatgtgaaggctgaggcttcacatgtcctcagaggctgaggacaggaggtatcaaaggtgatcttaactgatggtgaaacatgttggacgtattcttcaacatttcactggctctgactagtgaaataattaaaaggtattgtagggaatctgggataactcattaacacgaagaaagaactgcacaaccaagacttaggaagggctgggaaagaggacgctgtgaatgacctgcagcaggaacttgctgacctctacctgagagggctgcccttagcatgcttctctctgggtgttcttgaccatggcatctacccaactcccagtcttcaagtttcaaacatcaacgaggaagattctgtatgtaggtcagacgaatgccgttggatcaatctgttattgtctggatcaatctattattgccaagtacaaaagagcactagggacccgctcctaatgactggggtccttttaggacaaagaaaactcttgaagggccatacagctgcttcaagtcacctcgggtgaaattgaaaacaggaacgtgtagagaggtgaagataattgaatttttgataaagttgttcttgagaaaccatcaggtaatccaggtagagctgttaagctgataacttaaaatgtggagctatgccttgggaagagggccagagtgagagagaagataatctgggattcatccacataaaggagataattgaagtgacagtagtgaatgagatattcagggaagagagatagaaagagaaaagagcaaataatcaaccttccagaagaaagggtagccaacagtgccagagcaggattagtaagtgagatgtaaggagaacctagaaagtaatgtttcatgggagtcaagagaagagagagcatcagagacgctggatcattgagttcactgtagaagccctatcaatcccaagtgaaagtttcgtcccagcaccaattagctttaggcaagtgtgtgtacaggggccatttctatgtgtgtgtacatgtccagaggactgaagggcaggggtggaatataaaagataatagttaaaaagatttcaaccataacatgtgatctacaataaaagtctatagccacactattgattacctataagggaaaacttccataaggcaactagactttgcttttacattattttgacaaggttcatgaatagataagagaaagtagatctgaggtccattggtctactgaagttgtcttcaagtctgaaagagtgaagggctgaaattttaattcacatctcattccttttaatagtctggcttaaaaataagaaaacacttgtctcttcatcagtggcagaagatgaggacagggtcatagatctgaataaggataatagttctttgcaaagaagtactccaaatggaggatgactcaatgtcttgacaccagtgagaataaattgcacagtcggtgcacttaattgtaaagttcttatgcttttttattcaatccaagacaattcaacaagtattattgagcatccagtaagtgcccaacattgatgcaggagttgggaatatgataggtacaaatgagccagctcttctttcttggagcctacagtcaaatgggaaatgcagaaaaataaagaggcagttattaaatattatagtgagagcaaaggtggtttcatcctgggagctcatttcacagacacttaactcactcttcattctagacaggttttctgacaaaaagacatcatctgaacagagctcttaagtatgagcagggtcagacaaagataggaaaaatctgttacttatagagcaaacagtggtttcaacagcttggaacctagagggagatcatacttcatcttagacataggcaagagctcagtttcctgagtgagtgtgtttgggtaggaataacacaaagttgatgaattagacaggaataaatcatatttcaagatacagggctattaacgtaaacaggacacagatcacgaagggtctttagagcacccaaaaaagagggtttttgttgtggtggtgttttttttttttgtttgttttttgttttttttttttttttttatcttgagagcatgagagagccactaaaaggctataaacagaggcacacagcatcaaatgtgtccttcagaacgatcaccgtggttgctgtgtggacaagtgattgagggtttgggggaagagggtggctggtctaaaggtaaagggactaattaagaggctgtttcagaaattcagggacagatgatttaggaatgtggcaaactgactggagagacttgaatggatgtgacagatacagacgtgatgaaatctatagatattgaaaaccaatgaaccactagggctggagaggaaaagagtacaagatgatattcaagttttcagaaaaaaaaataccatttctagttgaaaattaagaggttatttgcaaaactaattacagtataaaagactaacaaagtgtgcaaagctctgaaacaagaaggaaacagaacatgcacgttgcaacttagaattttctggtagaggcaacttaaccttcccagagtattcatctccacgtttggggcatccagccattgccaaggaagggcggaaaaaaaagaattgagaatatgtgccatgtgagtgtttgttcatgaccatttaaaatcagatgcttctgcagtgtagacccttcctacgtcccttgtcttagaatggtgaattttccaggtaggcatataccatcgattccagcaggtgctaagcagaaggatctgcagctaacatgcaaatgattagcaaaaaatttggctaattctcagtaccactgccaactccagaccaaaaccaccatcctctccttcatgactcctctaataagtcgtctcagccgctgcccttgtctccccatattctattctacagaaaaaaaagatagagtaatattttaaagcatagatcaagtcatgtgactcctctgctcaaaaccttccaatagatcttactaaaaaaagaaaaaaaaaagacacggtggctcacgcctgtaatcccaacattttgggaggccgaggcaggcagatcacatgaggtcaggagttcgagaccagcctggccaacatggtggaaccctgtctctactaaaaatacaaaaattagccaggtgtggtggtgcatgcctgtaatcccagctactagggaggctgaggcaggagaatgacttgaacccgggaggtggaggttgcagtgagccaagatcgcgctgttgcactccagcctgtgcaaaaagaacataacttcgtctcaaagaagaaaaaaaaaaagataaaatcccatttaaaatggggtatgtgccttttatgataactctttgattttttgtctcactacacaccccttactcactccagctacagcggtctccactatgtgccttgatcatacagacatgcttctatctcagggatattgcacttgcagtttcctcttcctagaccttagtaagtacagcagctaccttctctcaaattacatgcttccactcccaattcttcctcacctcttccaaacccttttatactttttagcaattaccactatcatataaactacatattgtttttatttatcttgtttttcccactaggctctaaacactattaggcagaatttttaccagctttattcatgattcccagcactgagaacagatttgacatgtagtaggaggttgataatgagttaatgaatgttgctgaaatatctaccgaaagcaacaaacatttaccttcatgaatacacatggtttccccttaattaacatacatagatacaatacatcacccttaaatattttgtattgttatgttaatagagaaaaaagttcaatttccccttgggagaaaacactatgaaattgcttaattgcttatgaagaaactgaaaatgtaataagtaactaaagttctaaaaaaatttgagtgaccacaaaacccctttaacctgccctccaagtgggtcctgaaatggaaagctcttaatgtttatttgggtgataagatggatttggccagttcattttggatttgaactgggcgaggctgaattgccctgcctaatagaggaaggtgggatttgaagtggcctacctcctcctgtttcctgggtggagctgacttggttctgtggatgaaaaaagggatgaaaatgaagaaacaggaaccagagaatgcactctccttaagcaatgacaacagtaatttattgagtgcctactctgttaaagatacggtagcagagtcctcacatatattatcccacttaactgtcacaaggactctgttaggtgtatattatctgcacttagcagataaggaaattgagagaagttcaaagtgctttcgtttttgcacacaatttattggtgctgggattgaatctaatctgactgctgtaagaccctctttctccaccaaatgacgtttatttgttcttggaacctctcgttccttctcaccacaaagtagaaggcatttttcttcagaaataactttaggaataataattttgtttccagtaagttcattaaaaccctttgtaacttataatacagttgaaaggccaacattgtttctaggaaatgtgagctgggagctttaaactgcagacttaacaagtcaactttgttatagtctgtttccctcttcttagaggagataaataggcagcactgttcaattactcaaactcattctgtgtttcatctttccagatagcatttagccttgctttattttttcccaccattgaagtacaaaagctgcctggtttttcactgcacaaagtaaatgatgagcccggagccaatttctcatctcagacactgcagttttcaatgtgcattctgaaagctttgaatatgactataaacacatcaaccaaaacaaactgtaatttttataaaataagcctcagagtatgttttgctgaaacttaacaccttttgtctaagggaaaaagcagaaaaggcagtaagagcagaatactcgtactccattcactggcagtgctgaatcccatgtaaaatctggtagtgcataatcaagacatatggcctcatctttctttgccacttcccaggagtgaggtgtttaagaaaactgagaactcttcctggccaattcagaacggggttgtctgcagcaatgctgttcgaagtgtggcatcagcaatacgtgggagagtgttaaaaatgcaaattctcgggcccaccccagacctactcaatcagaatctctggggtgggtgcagcaatctgttttacaagtactctggatgattgcgatgcaagctcaagtttgggaagtataaactaaagggaaggaattccacctgaacgcagaacaatgggattcaagtcactggaacatcaattgacagagaattattctgagataagtcctttaacctctctggcttctgtgtttcttatctttaaataaagaaattgaaacattttaaccctggatcacatcttaacctattatcagagcatatcatggttacctgacactggtataaacatccctcacataatgaaagatttgagtatcattttctgactgctcttattttttctagctagcatcataatgacaatcacagcaacaacatcatgggagggcctcctgtgttcgtgtaccatttcccaagtttaacacgtttgatctgctgatgtcctctagtagtaatatctccagtttaggactgaggaaacagagcttatgtcacttcctgaaggtcacaaagaaagtaaattacagggctgaaatttgaacccacatctgatttcaaaatctgctcctccctttctaccaacgtctatcttcccggaactggtaactttcattaatgagaggaagaaaacaaaacaaaacaacacaatccataaggtggggctaagcagacctcatttctgtgaacagtgtgattccttgaagtatgtaaggcaattactttgaatacatttaacacacgtattgatttcatataaaagccactttacctaagagtgatcaataaacaacaaagcttacttgtagttgtactaaactgctgatttattgacaactctgagatattttgtccctggtgaaaagacacaaaaaatagaaactggagagaactttggaaagcttctgccttaaagaggttaccataggcaaaaggaaatttagaactagagaagcctagcaatttatttaaggtcacatggctggttagtggcagaaatatggttggaatgtatcttactgcccacctgagttggggttattgctgatattattttattaagtgaaactggatattgtttcagaggaagcttataaagaagtgtggtagtgcagattcttcaatgataagccagaattactcacaccaataaagttaagatgctaattctgggcagaggcaacagcctaaagcaaaggtatggggggtctggaatcgcatgatgtgtttggggaacgattagaaattccatattactaaaaaatgaaaaagtacaaaccaggaagcagttggaaatgagcctgagaggtatggagtattgaggttatgaaggactgaatatgtcatcccaaggcatttgatgttcataaggggttgctaaagaattggtgcaggagaatggcatgaatagatttgtattttagcttgctttggctatagtatggatttaaggggtgaggaaaggaggaagatacagcatccaagactaaaaaagtgagatgagttgggcttataatattccaggcagcaaatggtaaagtctgtgcaatgtcaattttacaagcaatgaagtagaagaggaagactcaaaagattttttgagaggtaaaataaccacaactcagtgctcgattcaatgagaaaggagagagtatatgggcgactcccaaatttctaacttggacaactgatgaatggtgatgacatagggagaccaaagaggaatacattgggccaagtggaaatagtaaaactagtattgagttcactgtatccctgcaccatcgctgtcaagatatcctggagagacagtccacacagaggtgatggtccataccattgcaatgtgtgagactccccaaggcaaaagagtaacacagtcaaggtgagagtcttggagaatgttacagaagaggaggagcctacaacaattactgtgggagagaacaaaggagttggaagcagagagggaaagccttgtgtcaaaagccaaaaataattttctttttcacacttcatgaattataattagcttcaaattcatagagttccacggaagtcaaaagtgacttcatttttgcaatatgggtgtcactggtacagaagatcagtaaggatggaaatgcaatcacatggagacgttagctgcagaattgaaacaggtgtgtttctgttttacgggattcaaaaatgctaaaggggagaggacaggacataggaacaaagtggtgcaagcatgacatataaacatattgaggagcaagcagagaggaagaagtgaatgtagggagagaggagacaagtgatagaacatctctgaatgtggagggaccaataaggtgttatttggctttggcttagaaaaactgagactcatgtgaatagcaaaagtatagaccttttcatataaaatattgtactattacgggagttaatgcttatatgacaggccagaggttccttgtaaaaacaaacaaacaaacaaacaaaaacccaataaaaacaggggttcccagattataatgttagctgcagatcagatgtttggaaaggccacgagtttcccctgacatccacctggtcacatggagtggctcagtacacaggcagagctggccacgtgttttccctgctttggtaagccagttacctgcttctcaaataatcaggagaatataatctttggcagtgtgggtatcatgcagataaaactaacaagtaatcattggggccttctcactttttcccacttattgaagttttttctgaataaataccaaaaagcctaatcatagaaagctttaattggctcaattctaattaatatacagatgattaagataatttatatttcatatttatttattacgtgaacttccttaaaacacagtatctatctaccatttttttttctacatataacctgcctgagaactcagaccaaatgagttcccaaattatgctggacagtaggacaagtttgatgaatttcaccataaatatggtttggcacaactttatttgaaaatagaattatagaatttaagaggcctcatatccggaatgcttatatagtttgaatgcagagtgactttggttatagtgaaggaggaaggacaggccctcagttaggtgtctcaaataccttcttatttaattacagcagcatctctaccagagagtattacgcaattatttttatcctaaaacatactctttcccctgacatttgcattttttctgaaatttgcatgcaaactttggttgatctactcattaaaaataatgtttattcttcgcacctcatgcccttaaaagtatttatgtcaataggagagcaatagagagccttaaaatggaggcgattgaagcacagagagactacgcatctcaacaaggtacacaaaccagaattagtagagccagaatttgaactcacgtctatctaacttgaaagctggttaagagcaaatctttgctatgtagatgaaggcactatgctgggtcctgataaggcagcacctgcccttaagaaacctgcatgcagaggaggaaatggacactaaagaataaacaagtagataagagaaatttagatgctccataaattctacaaaggaaataaaacagggtaaggtaatagaggcagattggggagttgcttcttgctgtcctcttccaagaggtaacttttgaatttcttcccattcttgtaaaattgggcaacagcacataccatgtaaaagaagaggacttgcataagccgtaagatagaaagaaacttgcttttgaccaactgtaaatcagacattgccactcctcattgtaagctctaggtgtctctttttaagggaccataatctactggggaaaacagataagccaaattatatatgatgttgttatacatcaagagctataatggagatgtgttcaagattctacagaagcatggaagaatggaaatttgctgtcggtagaatgagtgtttcagaagtaaagatgggagttaagttggtcttgaagaaataggattttgcccaggacatggggcagggaatgggtaagtgcatgccgtgcctgggagatgtgtctgtgtcatgtaacacagcatggaagtctgatgaaggatggcattggcagttgtattgtcatggcggacctaacttggggtgcagaatggggcatgacaggggatgttctgaacaagatgtagcacctggaaataattaagcttggcaaggtctcacaataaattctctctgttcttgaggacaaatgtcactgaaaatacttcaagtgaatttcctggcagtgcctggctgactttccaaggtctcttgctgaataatgtagagggaacactgtttgagtcagtggttctcagtagaatcaccagtagaacttaaaataatatgaacacaaatttaaaactttaaaaaaatacccttgaataattaaaatcagcaggtctgggaatggggattgcacattggtgatttttaaagatcttcaagtgaatgtaatagtcatccagcgttgaaaggcactatttctagaagacttggaagggaaactgagttttcctgaaggcctgagacaccgtatatggcggaacctgtacagaaagaagtcatccaagaaaagacaaggaactgacagggactgatcttaggactggcagtgtccatgttccagggtttagaaaaactcattttttaaactgttgtgtttacatagtagatgtatatatttatggagtatatgggatatttagatagactattgtcaccctgtcatgctttcaaaaactagatcttattcattctttccaagtttttttgtacccattaaaccatcttctctactctgcccccgacccacccagcaacttcccttcccagcctctggtagccatctttttactttagagaaagtcattctgaaagcaaagcaagtgaaagaaatgtaatctttaggcaaccaagctctgaagtctaatggtgagatccgaatttaatggcgctctgaatactcctcagtaattatctcagaagaaaacaatggcgccaaagggaagccctgattttgaacagtcccaggtgacagtaaatgagaagtaatctgactaagaaaccaacggagagtcatcccttgactttcttttccataatgacacctgaagcacacttgtttattctgtaaactttagttaaacaaatttaccctccaagacactgggggtttgccagagaacagttagtttaattggagctcatctgtttttgttcctaatgagcctcccatttcatagcctgctcctagtttgaaataaaatgtcccccctgtctgggatgattaaaaacctggttaagcatacaatatacagtagctgccaaaatgtttccaccaggcaatactgctcagaactgagacctgcaggcaggattagaagagagaaatctgttgattttttccagctcaaaaacaaacaagcaaagaaatcacatccaattatctgagttatattttattaaagaatccaccggagaactgcattcacttctcaagatttgctaccaaaccgtctccccattctgtcttttaaacactcctccaccctttttgttctctagttggtttgtaatttagaaagtgtgataaacaattttggggagccattaagttttaccagtgtttctgtctgaaattaggctactatgtttgccaaagagctgctctgtgctataaaatctttattaaaaatacaattatttacaaaattattaatacttatggattagaataaatgtgacttcatcttgcagctatgggcattttctttttgtttttgtttttgtttttttttgagacggagtctcgctctgtcgcccaggttggagtgcagtggtgcgatctcggctcactgcaagctccgcctcccgggttcacgccattctcctgcctcagcctcccaagtagctgggactgcaggcgcccgccaccacgcccggctaatttttttgcatttttagtagagacggggtttcaccgtgttatctaggatggtctcgatctcctgatctggtgatccgcccgcctcggcctcccagagtgctaggattacagacgtgagccaccgcgcccagccgggattttctttttaagaaactgtaaggtgctaatcattgggtatttcattaggagacacatttaaaaaatctgattctccaagcactttgttcttagactcccacatccctttcaccctcccccaaattcaggatcacaggatttcttctgtctgccttatgtattttgcaagctaactattgcactagaaaaaaaatatctttcacaaataatacagaggcagatgttttctggatcataatgatcaaatagagtgagctaaattgctcattgatctgtgattccttgtcatttgaaaatccgattaaaagtgtagaacttttagaaaagacaaatatacacacactattacatacatcataacactaagcgtgaggagtgggattcatgttatgaatacatagcatttgttctgggaatagcaaaaggttgatactcaatacatacttatccaatgaataaatgagtgaataaaatttcaggatggatttggatggctttgcaagtgagtgtcaataaaccctgggttcagagcctccattatgaacgaaataattatgaaattgaattctcctgatttcttttggccttaaagactttctttcctttactgtgttaagggttgaccatctccttcctttccaaacaattaaaatgtatggagggcatatatgtttgattaggttttcatgtagagaattacagttacttccagcctgtctcatgatttccttgatgggatatttggttgttcctaaactcctctgtagtgcatttaattactatctcatagttttcctaccacatgtctaatgtaatgcattttattcttacagcttcattctcaaaagacatcatttatccctttatttccaagttcctagggcattttagtacatgtcttgacaaaggacatatcccttctctgctgctggaatgggctgccgcctctgagctgcttcaggcacgcattctgaaaagacgttcacacagggaaaaattccgttcaccttccttctcattcaaccgtcctgattttgtctgtgccattttaaaagacttgtgtgcctactttctttgtcagctacatctgccataacaaaataccaaagactgggtggcttaaacaacaggtatttctcacagttctggagattggcaagtccacaatgaagatgatggccagtttagtccctggtgagggccccactctcatgacctaacccaaccctaattacttcccaaaggactcttcttcaaataccctcatactcgaggttaggacttcaacagtaggtcacacacttactgctaattaaggatgtctctgaaagctgtagggggtcacagatgtcactaacaccaaacaatgaaaaagcacaaggcgtcttctttgattcgttgttataggaacatgtccacacttccctccctccccttcgccagtcactgaaagaatacaggatgtgactataaagtgatgtctccaatttttaacatttaaaatagaaaagaaattgtacatttaaagaaaatatggtgccttttcaagaagtcccttggggaaccacactcttagtctaatgacgcttctgaatggcagagcacctttttttaattccccaaagaaaatgcctgcagactttgtggcgtgttctttcgaacgtccgctgccaggaaaatccctgacctttatgcgatgaatttgattttgggaaatagcaaaattgcctttggagacaagttttgcaatcaagttaagtgatcacaccagagaattctgcttcaggaacaaaactgggacagataatagactaataagatgccttcaccaccaggcttgtaaaacttgtcttgagaccaattacaatatagaccttttcaaacttatttttagcaataagagcatagtatggttagtgtgtaaattaaggtaaaaatattgaaacacaagatatatttgaaagcctaagtaatcctattttttagtttaacctttccaagactgtctttgcacacttggatttttatttgaaaataacaccaatttgaaattcatactaattgatgctaccacttcaagagttcatgaaaccaagcagtttcaagtgaatttgcgttggatcaccctgtcctgagagttaccttttggaaaacataacctgcacatatgtctcatttattctactcaatgcctcccgatgaaatcagtagcaacaatatatgcatagtagcgaaataattgggcaaaagatgaatcataattttgattgtaattgggggcagtgagagaggaggaggaaaatacagtcattaaaaacatatataagtaattggcttctttgctttcttgtgaaatatgctagccccacaacatgattcttactcattaactttagaagtgctgtttctaccgtattcacttcctagtggcattgcaggagatccgtttgcaatttgtgtgactgactcaagatttcatacaactcttgtttctgaaatgtcttctgatcactgagtcataagagtaacacttctcaagttgttattgttctgaaagtctttgaagggtctgggatacttggacaatattatttccatcggtacttttccatcctcctgtgtatggtattatttccagccaactttggaaaaatagcatttcaacagctttgcatatccacattgcacctgcttctggactataaatgattacgtataatttaaatttatagaaaatgttcacaggaaccagatcacagggcacatatgtgactactgattgcttctatttcttattttccaagtataaaaacatatttataatgaaaagcttatacttgctttatctccaaatcaacaaaaattaaacctctttgatattagccagatagactactctttcaactttgaccttaaaggacaataatgaatctcattaaaatcatatttccaaagtggctttcagaaagtctcctactcttacactatccccaggttcaacaagtttatttttggatgcacttaatgctttcgtttcttcttttcagattctgatttaatcacttagcttctgtggcataatcaagacaagttggatgaattgtctcctaactggattataatgaaagaagctctaactggtcttaacgtagtttcgatgtttggagtctttcacaaagagaaacaaaagcatgataagaatgtgctaagctaattcgaaagggaagcaagggtgtcacaattaaacaagggtgtccaattatattgttcccatacatcattccaccactccaataggacatgggcttatagagaacagagtcaagccttgtggttcctgttgtgcccagcacacacagcattgtgcttggtatatagtaggtgctcaataaacatttgaatataatttaatctaggctctcccagggagaaaatatagtttagggttcaaggtaaagaatctcaacatggccagcacagtggcttatgcctgtaatcccagcgctttaggaggccaaagcaagaggatcgcttgagtccaggagttcaagaccagcctgggcagcataatgagtccacatcttcacaaaaataaaaataaaaaaataaactggatgtggtggcgtgcatctgtagtcccaattaatcagattgcttgagcctaggaggtcaaagtttcagtaagcagtgatcatgccactgcactccagcctgggtgacagagtaagaccttggctcgaatcaaagcaaaacaaaacaaaacaaaaacctccaaaacatttaaacattagattctccagatatatgtatgttttgtatatcgatcattctatgccacaggaaatgttcaaccaggatctgggtaaccagattagtgtcacaaagaaggagtttgtagatcacctaggaagtagaactaagttatatctaagcaaccttacaaattgaaaatctatcagtctttgaaaacatatctgttctatgtttctcacagtcttattggtgatgggataatgaccagttggccatgatcttaacaggaaacgacaatgtaatatgctagcccttctaggtaacatatttaccctggcacagaatgccttaattccaaggtgtgactcactgtaatcctgagaattacagtaatttgggggtggaatattatggccaaaggcaatgagcacagaggaaacttctcactgcgaagctgagaatgaactgaaatgatcaaaaattgaatgcttgaagtcttttaataaattataggtagaaggtaaactcagctatttctggacagcaggaaagggtctaaacagaggaggtagcacagacgcagcaatggaatgtgaatgagtcatatttccacatcagtagggctatgaggagaccactctgagatgatatgacagatagtggctgcattcttcagccctaggaaaaatgaagattgcaggaattaggttaggaggtgaagactttcagggaggtagagtgggaaccagaggccagggagagtgttgtcaagtatgctgaccacacagtgaacacagaggatacagcttgatgctcctgaagtcattacaggcagggttaaattcccctcagtgacccactgacccccagacaccaggcatggggtcgaccagctctctccagttcttctccaccactacataagagaagaagccttgaaaatgccaccaagcttttgggctcagaatgaatcatgatggaagctactgcagccttgacactggaaggcatttcagttctgtcaactcttgcctcaaaggaatgttcatttccttttacacaagataaagcttctttgaggaggatttgtgtcaggtaaagaggaacactgaataaactgttgtggtggatgtcagtgtctattctgtgcctgaaattggaatttgggcttagaacttaaatacaggatgtgactcaatgaacagagaccagagttccagtacaagatataaagagactttgttttgaatcagttctagtatttctagaaattcttgttatatttgatggagtgaaatcggtaattctttgaaactctttaccttgtcagcttccatagtactctgctgtcctcattatccctttacttctctgagccttcacagaatccttcttatcttcccaacttacataaatgttgatgttccccaggaatccattctcagacctcactttctctatatgagctcatccatgctgcttcctccaatcatcaaccatattctgatgacatctacatctttacctccagttcagactttggatctttaaaatcatataattgcttctaccttctaggtctgactatctcacagataagcaaatgcaacatgatcaggatttatcttcacatccaagaggtccttctactacaagaccaccacatgccccatgaaagtcatactaaaaacttaggaggtgtcttgaattctcctttcccctcaaagcccatcatatctactctgtcaagtccttttcacattcccccaacactattcatggatgagtctcatcttctccatctctggaatcacctcgccttaaaggaaacatccaaatttatttttaaaatggaaatgtacccctatgcctgaatcacaggaaagcaataataataactgattaatatttctgcatcacttaaagaataacattcaaaatcacatgtcttttattatggaaatgcaaatcaaatcacattgagatattatgcaatacctcttaggaaagctgatatcaaaaattggaaagcatgaagtgttggcaaggatgcgtggatatgggaacatgagtgcatggctggttgaaatgtaaagtggtgcaactgctgaggaaaatggtatggtagggcctcaaacagttaaacgtagcattaccattgactcagcaattctacctttacgtgtgtgcccaaagaattaaaagcaaggattcagatatttgcacagcattgttcatagtagcattattcacaatagcccaaacgtggaaacaacgccaatgtccattgatggatgaagggataaacaaaatatggcataatatacatacaatggaatattatttagccttaaaaaggaatgaaattctgacatatgctatggcattgatgaaccttgaaaacattatgctaagtgaaataagccagacacaaaaggacgaatgttgttattagtttttctcagattacacatatttgaaatatcttagaagaagcaaattcatagaaatagaaggtaggatagtggtgataaggaactctgcggagagaagaatagagaatcagtgtttaatgggtagagcttcagtttgagatgataaaaatattctggggatggatagaagtgactgttgcacaacactgtgaatgtaattaatgccactgaactgaacacttaaaatggacaaaatgctagaaatatatatattatatatattataaaaatggagagacagagagagaggtagagagagcagatgagaaacaatgatactctatttttttcttctcacaattccttataactaatattggttatatatataaccactattctatatatcatggttatatataatatatatattatatcatataatatataaccatataatatatattatatataacacattatagatagcacagatgcagctatatataatatataatatattatattattataattaatataatatagtatattgtattaatataatataatatagtatattgtattaatataatataatatagtatattgtattaatataatataatatagtatattgtattaatataatataatatagtatattgcattaatataatataatatattaattatatatatttttatttctagatatatattatataatatgatatataaatatatacaatatacatttataaatatataaatatatataaatatatactatatataccatatataaaatatatacaatatatacaatatataaaatatatacaatatataaaaatatataaatatatacaatatatacaatataatatgtttaatatataaatatatataaatttttttttatatattaaaaaagagagaaagcttacggcatgtcaggtactatgcttaaaaaataaaagagtatataaatatatatatttatatatatctagaaagaaaaaaaacaaattgaaattacatgccatctcctacttcacacctcgggctccagcagctctatcgtcacctatgtaatcttcatttgcacgatacaccctgtccatatgaattgacagctgactgccactctaggacccttttctgcctccttacaaactggatgagggcttaggtcgctgacaatattccaaatatacccttttattttttaagcatggtacctggcatgctgtaagctttatttcttttctttttttcttttttcttttttttttttgagacggagtctagctctgtggcctatgctggaatgcagtggcccaatctcagcacactgcaagctctgcctcccgggttcacgccattctcctgcctcatcctgagtagctgggactacaggtgcccgccaccacgccctgctaattttttgtatttttagtagagatagggtttcaccgtgttagcctggatggtctcgatctcctgacctcgtgatctgcccgcctcggcctcccaaagtgctgggattacaggcgtgagacacctcacccagccaagctttcttttatttttatttttatttttttcggatggagtctcactcacacggttgcctaggctggagtgcagtggttcaatctcagctcactgcaacctccgccttctgggttcaagcaattctcctgcctcagcctccagtagctgggattaaaggtgtgagctaccatacccggttaacatgcagtaggctttcagcaaacactgagggaataagctcatgagaagcagctatttttacaaatgtaaaatattaaaattggaaggaatcttaaagtttagtctaaattcttaagaaaagtgctattttgacatggtagacaaaatggtgccttccagaggcctaatttccattttaaattaaatagcagcccccttttttcttttccttttgccaattgattctaccattttatgaactcatagaagggttagatctgaatcacacaattcattatgtcaagtgttttccaaacttcaagaaatcttatcacatcttcatagtgcttgctctacccatggactagctgttcaaatgttcaaataagttcatcttcatccaaagcaatactgtcaataaaatataaattattttatcttattttaagttccaggatacatgtgcaggatatgcaggtttgttacataggtaaatgtgtgccttagtggcttgctgcacctatcaacccatcacctgggtattaagtcccacatgcattagctatttatcctgatgctctcccttctcccaaccccctgacaggctctagtgtgtgttgttctcctcaatgtgtccatgtgttctcatcaatcagctctcacttataagtgagaacatgcagtgtttggttttctgttcctctgttagtttgctgcggataatggcttccaattccatccatgtccctgcaaataacatgatctcattcctttttatggcagcatagtattccatggtgtgtctgtaccacattttctttatccagtctatcatcgatgggcatttggcttgattccatgtctttgctatcgtcaatagtgctgcaaggaacatatgtgtgcatgtatctttataatagaatgatttatattcctttgggtatatacccagtaataggattgctgggccaaatcgtatttccagttctaggtctttgaagaatggccacactgtcttctatgatggttgaactaatttatatgtccaccaacagtgtaaaagtgttcctgtttctccacagtctcatcaacatctgttgcttcttgactttttaataatcgccactctgactggcatgagatggtatctcattgtggttttgatttgcatttctccaatgatcagtgcaaatcacagttttgatgtggtgtttatatatttttagtacattaaaataaataattaactagtacaataaaaactcacggatgtaccacctaatgtcattttcttgtactacatggtatgtaaatcatgctttgaaaaatcaatttgaatgcatgattgactactttcttgaattatcctccagggtcctgcatagacaactctgattcctcaacaagctttcacactctctaaaagcaactctctaaactctctcttttctttgttgtcatcgttttatgtttcttagctccttgacgtttgtcaagctctcaccgtattcaacaagtatctgttgaatagatatacttgctgcttctgagatggtatatattatcttcccttataaagtgaaagctatttcataaggttataaaattggaaggtgagatgtccatgagattgcaccttgcaaacattcaagtacaaggaggcaattgaatctgggtcgtggctcctgtactcctgaatgtttgcactaaggccacacctcccacagactctttcaaccaatgactgaacctgtagaggatgcgatggaaggcttctctctaggcaacatggaactcctctcatagccaactttggtttcagaactccctgaaagattgctgaacctattgacactgcacggtggtctagatcacttccaccaacttcccttccccctctccttcacttagggtcagacttgcatcataatttgattgattgttctcccactctttctctcctcatttttttggagggattttttcttaataaagtccctgtatatatagcgctgacatgcttcttgggatacttggactaacatagaaagtattagtgagaactacataaatgttagagatatttcaagctgaatttgtctatgagagtttggatagggttaattctgaattcagacagtgttgagttaaatttctgaattacttagttgtattagtttactagggttgccataacaaaataccacacatcgggtggcttaaaccacagaagtgtattttctcactcttctagcagctaaaaatctgagtttaataagtgtccccagggttgatttattctgagggcttcctccttggcttacagattatgatcttcaccctgtgtctacacattgtcttccctctgtgtgtatctctgtccatattttctattcttttttgttgttgttgttgttgagacggagtcttgctctgttgcccatgctggagtgcagtggcgtgatcttggctcaatgcaacctccacctccctggttcaagcaattcccctgtctcaacttcctgagtagctgggattacaggcgcatgccaccacgtccggctaatttttttgtatttttagtaaagacggggtttcaccacgttggctagactagtcttgaactcctaacctcaggtaatctgcctgactctgcctcgcaaagtgctgggattacaggcgtgagccaccgcgcccagccaataacctcatattaacggaactacctctttaaagaccccatcttcaaatacagacacattctgagttactgggagtgaggacttcaacatttgacttttagaggaacacaatttagcccatagcaccacctgaataactttgagccagtcacttgactttacagagccttagtctgtaaaataggggacaatatctaccatattattttgttcaaatcaaatacagtgacatatataatgccactggaacatataaggcaatcgtcattaaaaaaaatcctcccaatttactaaaatcattgccattactttattagaattaatttatataggggttctattattcgcagtatgtctcacagctatataaagtagcattatatgataaggttgaaaaggaagaggaaagaagtatacagtgtctgattgcatagcttcatgtttatgatatgacagttctatgattctgagcctggcatatttatttaagctatacaccagagttcagaaattgatagttaagaggcacatttggcctgaaaatgtctgtgattttccagagagtattttaaaaatcagaatagaaatgcctttaaataaagcatgcttctgctgttttccacagtttttcatatccctaacacatggtcacattatacaggtataatacttatctagcccttaaaagcttttaaatggacaatctttgaagcacagaccacaggttcagaatgtactgcttctatgtccttgactattctcaaaagaacatattttctaccatattatctaaattatctgagaaagacacaggtgctgctacattgttatcctctagggatgctcacgtttcttcaatatccacaaattcctcctacaatcatctaaggctgctccccattccaccagtaaatattaatcaacaaagtaacaaatagtgcgatgtgccaagcatctttagcgatatgcaccctcaacttcaaacagaaactatttgggatgatactccctcttctgcctgtagataggtaaacaccctctgcaccctagatttaccaaacttcatgacgtacccaccctaaaaggacacgatcttcagggtacacagagtttttctctagatgcttgacgatatcgccattcttcggctatatgagcttgctttttaaaaacaattacttcaggaatctggtatccagaagaaaatagggtagttttcaaactttcattgcattatttttcatgatcaagattataaggtaaattggaactattatcatgattcactcttccagatggttatgcaaagattgagtgaatgaatagagacaattttaaagaaatgaataaaataacttgtatggttaagtagcaaagccaaggagaagttgggaggaagagttcccaaattgccttcctgagactagacaatttgagtaggtcaagaatgagaatctctacagaaacttgctaagacttttaaatgcagtcatgctttgcttaaggatgaggatgcattctgagaaatgtgtccttaggggattctgttgttgtgtgaagatcacggagtgtacttccgcaaacctagaaggcataaccgactacacacctacacgatgtgatatggcttattgctcctaggctgcaaacctgtacagcatgttactgtattgaatactataggcaactgtgacacaattttaagtatttgtgtattttaacatacctgaacatagaagaagtacagtacaaatactatctaaaagtccaaaaataatacacctgtatagcacatttactgtgaatggagcttgtaggactggaagttgctttgagtgagtcattaagtgagtggtcagtgaatattactttataaacattgaagactttataataaacattgtacacagaggttaccctaaatttaacttaaaatttctttgttcaataataaattagcttacttgcaactttgttactttttaattttttaaaagcattttgactcttgtaataacacttagcttaaaacataaacacattgtatagttgtacaaaaatgttttctttctttatattcttattctataaaattttttctattaattattttactttaaaaagaaatttttgttaaaggctaagacacaaacacaacattagcctagacctatacatggccaggatcatcaatatcactgtcttccacctccacatcttgtcctgctggaaggtctttaggggcaataacacctgtggagctgtcgtattctatgatgacaatgccttcttctggaagacctcctgaagggcctccctgaggctattttacagttacctcccttttgaaaaaataagtagaaggtgtatgctctaaaataataatgaaaagtatagtatcgtatagtatagtatagtatagtatagtatagtatagtatagtatagtatagtacataaaccagtaataaagtcatgtattatcattagcaaatattatgtattgtgcataatggtgtgtgctatgctttgatcagactggcagcacagtaggtttttttacaccaacatcaccaaaaacactgagttatgatgttatggcggctacaatttcatatgtgatagtaatatttcagctccattaaaaccttgagaccaccattgtattttcagttcattgttgacccaagcattgttatgcagcaagtaagtgtgtatttaagctgcttaaattaatttcaattgctgttccaattttcttagtcattccacattttgttatgacactcctgaccatagaagaatgcagcaaaacctcacaattcataaaatcacatcagctgtgcacacagatgatgtacatttattctgtgtaagcatcttaaaaacaaactcaaacccattcttttttccattgcataacctttaagcacaatccaaacatttcatttgatgctattaaaaagatctgccgatgcaaaaccatattatagccaggggtggcgggttaatacttcaagtattttcaagataacttttactgttttggctatatacaaggtggtgcctttgcactgattttgtcaccccttagcatgagatgaaaatccacaggaatttaaatctagaattagaacatatgagcaagaaaatttgatttctttctgatgcatgccagaaatagtatattaacaataatacaataaaggaaattcaaaaagtattcatctaatccttactaaagttattatcaatgagttctaaactttattttgtcctttaagaatcacaaattatttgtttcaaatgatcctaatcatcatctaatgtgtcttatactgctatcctataagtttttttgtttttgtatttgtttttgttctttggagatggagtcttgctttttcgcccagtctggagtgcagtggtgtgatctcggctcactgcaacctccacctcccagattcaagcaattccgcctcagcctcctgagtacctgggattacaggcacacaccaccatgcctggctaatttttgtatttttagtagagacagggtttcaccatgttggtcaggctggtctcgaagtcttgactttaggtgatccaccctccttggcctcccaaagtgctgggataagtttttatcccataattaccccataaaatttgaataagaaaatgaatgcctcaggaaaggcaatataaaacaatgaagacattaactagtagtcattataaatatagttaaagacctaaatgaaatcatgcttatagaaatagagaaagccatgacaacaacgtttcagcaaagagagaatatcaataaagatatagacattattttaaaaagaaccatctggaaatgcttgaattgaaaaatataataaccaaaataaaaaattcactagcagaaagtgaaaagacaacccacaaaatggggaaaaatttttgtaaatcatttatctgacataggacttttatccaaaatatataaagaatttctacagcttaataatcaaaagaaagatcactcaattgaaaaattaagaaaggatctgaatataaatttcttccaaaagtatgcaaatgaccaatatgcacctaaaaagatgctcaacatatttaaaccattaggaaaatgaaaatcaaactcacaatgagggccaagcacagtggctcatacctgtgatcctagtgctttgggaggcccaggcaggaggattacttgaggccaggaatttgagaccctatctctacaaaaaaattaaaaagttaaccaggcatggtggtgcacgcctgtaggtctagctactcaggaggttaaggtaggaggatcacttgaacccaggagtttgaggttgcagtgagttatgatcctgccactgcactccagcctgggcaaccgagtgagactctgtctgaaaaaaaacgaaaaaagaaaaatcacaatgagttagcacttcacactcagtaggatgaccataatgagaagcacagaagaacaagtactgggaagcatgcaaagaaattggaaccctcatacactgtgggtgagaagggaaacggctttggaaaaccttctggtaattcccagttaaacaaagagttacccattatctagaaagtaagtgattttatatcatagtttctgctgcacaattttaattcatttattttactgacaaaatttaacaaatttattttagtgataaaattagacaacttaaaataatttgaaaccaagtaaagtaatgctttttcccttgcgacgtcattagctagtacaatgaatttttgagtatcaatcagtagtagccaccactcttgtcaaccagagtcctctctttagccaattctctagttcaaggcaattaatgtttttgaggttgacatgggagtcaggcatgactctgtggttccttccaaaccatcagtgaaatgtttaattatatttagtaccatgttttatgaagtcattttattcttggaattttggcaaaccttgaatcgtacttatagtcattccccaacaactaaaatatctgatttagtcttccagatattagagtttacataaatatttttaaagcttacattttcatatgtatatatttccaatgaaacccctatatgtttgaaccgtttctaaaattgtcattaaacacccagcaataagtctattattctctgtactaatttgctatacttaggctgtgtagaaagttttctttaatggtctcttcaaaatttcaactccgcccgctgacatttagtgaatgtcaagatgcttaatacagggctgtgctttctgcttttttcaatagatcctattgttattgacttatcctgatgagaaaataattctatctcaaatcttagaaaatgtatctttggatcaagtaagtatgttagtttcttaaagtgtccaacccttcatcaaatttttttcattgattaattttacaaattttaagaggaaagggagaagtgatcatcttattttatgtaatatgtttatttgtttaaatatgtagagcttattgaactacattaaaatagaatgaggctgtgagaccacatagaacctgagaggagatttaccagtaggtcaaagaagcttttactttaagaatatcaataatttcccaaggcaagaaaaatgtaagattttacatgctaaagtcatatagtcagcatcatttaaactgccaactgtcacaatttatgatttgtcatttagggtttgtctgacccccatacaggtgaggtaggggaggaagaagagagaaggtaggtccagctcagatgcctgctcaggtggtcagaactcaggagatgaaccatactgagtagctggaagagttaagaaacctgtgtaaggatgggccaattgtcaaagcagttggagccaaattctattcttagtccaagtgtttagcaagtgacttagagagacaaaactgctgccagaagtcaagtgaacaccattatggtgcatgtagtgaaaacaactgagagagagagagagagagagagagagagagagagagagagaactgcaaaaaggtcactcattgatactgttttttttttttttttttttttttttttgagacggagtctcactctgttgcccaggctagagtgcagtggtgcgatttcgcctcactgccagctctgcctcccgggttcacgccattctcctgcctcagcctcctgagtagctgggactacaggcacccaccaccacgcccggctaatttttttgtatttttagaagagatggggtttcaccgtgttagccaggatggtctcgatctcctgaccaggctatctgcctgccttggcctccctaaagtgctgggattacaggcgtgagccactgcacccggcctgatactggtttttaaaatttattttaatgatttaataactatttactgaattctttcagtatgccaggcctagattaggcttcagtgatataaacgtaaacaaaactggcacagtctttgacatcatggaacaccgattctaagagaaagagagaaatattagtctaatggccctgaaaataaaaacaagttacaatcatgaagagtgtaataaaggacaaagttgctgtgataacccataatgaggcaacttgacttctcagggtcccttgccttctggtttctggtcagatttgaccaatgggaggtaccagtaccagaggagacagcagagactgagatctagatattgtttcctctgcctcatgccaattatggctttctagttctcagagaagcctgtacatctccagcagctctggccatattctctttatggttccagctctcgttattatagctcttgttattgttagtatctggatggcttgagattaaagggtccatgggatgtcctgctgctggcagtggctcacacctgtaatcccagcactttgggaggccaagttagtttgctcggttgaacccaggagtttgagaccagctggggcaacaaggtgaaaccccttctcaacaaaaaatataaaaattagccaggtgtggtggcatgtgcctgtgatcccaactactcaggaggctgaggtgggaggattgtttgagcccaggaggcagaggttgcaatgagctgagatcgtgccactgcactccagcctggggggacagagcaagatactgtctcaaaaaataaaaataaataaaaataaaataaaaaaggatccatggtaacatcttcattaatttctttttagaatctgattgggatatagccttctttttcctgcaaggacaatggctgagagtcagttaggtgaaaactgggtaaaggcagactaagaatatgaaacagcatctgaggtggaggtgacaatggccagtcatagtcacgtgagtgtgtctggaacatggaacacaaccagtcttgcatgaggcaggagacctaggcaagagttggatgatgcaaacctatgggtcatttgggggttttgtctctattataaaagcatttctgaaggttttcagtcagacgagaactttatcaggtttcaattttcaaaagattattctgactgtgttgagaaaaacatattggggaatatcaacagtgggtgtggatagatcagtttcttaagagctttttgaacagtttgacatagagctgatgattaattagactaagatgtcggtaatggaggtagactaaaagaaattgaaaggtttaatcggggtcaacaaagtatggcctgtgggttggctgtcattgtaaataaagttttattggcacatggccacacgtatttattatggattgtctatggctacaacagcagagtagagtggttggaacagaagctgtgcggcccgtgaagtcttaaatacttactctcttgggctttaagaaaaacttcgtcacccctgggttaaatcaagagcatttggcattagattagatacggggctgagggaaaaaaagggaggcaggagagtcagggacgaaggagacgaggccacagaagctcttctttgacagtgataatcttattttaggtgcataattttgggatttataatatacagatatataatgtatgttatatatattataaatatatatattatagatacaaaatatgaaaagatatgtaatcttcttgtctttgtcaccaaatcatcccattgctgaataagacttcttctattgttcttttgttttaattgcaaaagtctagttttccctttgaagaaaagaagtagagaaaacattaattcacaagggaaaggaccgtttgtctaattttgttagaaggtctcagggctcagttctcttctcttatttatgtatattcactcttctttgttttttaaaaaaatcttatctaacctcatggctctaaataatttaacatgatgacaattcacagtttatatttctagtctgaacctctaaaattccagacaaataattaattaccttttcaacatcgccacttcgatttctaatagacatctcacaatcactgtgtccttaactgaattcttgacttccccttaagcagatctactcacagttttcccatttcagttgatgaaagtgccatcctttcagtcattcaggccaataccactgggaccctccattaggaactatgttgcctctaccttcagaacatatccagaacctcaccatctctcccctcccccccaattgtcactgtcctgatcagagatgtcatctttcctaggctgaatttctgtaatagcttcctagcacgtctacttgcttctatccttggcctacccactgtagtctattttcaaagaagtagagtgaaccttttaaaatagaagtcagatcttgtcacctctctactcaaaactctccaacagcctctgatttttacttgctcagacaaagtacttaaaactgcacacatgacctcacataatctggcttccatattcctctggcttccaatatgttttattcactcctctaaatcatagagtctccttgaattaacatgttcctgatccaatgtactgtagtaaaggagtgaaaagtaaacatgattcccagaggcagttagtgagatggttgcaggtaaccattgcctcccacactctcttccttccttccatcctggcataggttatttagcaaaatacttagtaccttctaatatgtgttacatgactgctagatgccagtgataggaaaatccatacaacataggaacacacaatctggtggggaaagatgatatggaaaccaaccaatgcaagacaatgcaaaaagtgcaggcatagaatgatgggctgtaatttttaaaaactcaccatgtctaagttgggaaggatagagattctatatgatggatgcaagatcattccaaccaatgtagtttggaagaaacccaaagcattctaaattatctagtgaacttcatgttgctctacctaaagtatttccatagtaaccaggcctgtgctcttgtgtggagcatgagtggctaaccactgaattatattccttttgtcacagtctaagagcaatataaattcctctttttttcaaaatgcttcccaacttgagacacaaacattctaccaagaatagatttgacttaattatctatacgtttaaaatgtaaatgcagcctttctaagagaagcctacatttgttaaatcaatctatgagatcaccttctttctaagatgagggtaacttcaatattgaagtgaagacagtatagagacactaagaaatctacccaaggacacacagctgatcaggggctctgacttaatttttttcccaaacattaggtttcctgagtgcaaagttgttatattcgttcctacctcataagattgctctgagcagtagaagtgataatatctgaaacatgtaggacactttctatgatgtactaacagtgcagtaattgttagtttctccaatgtcccacagccaacctatgctactggctgcaaattctaagttatggactattaaatgatctggtcaaaactggatatggataaaaatgcactttagaattacttttgggaagtagaggttgccaattaggtgggtggaaatgctttctgtcctgtaaagtccaagagttgtctatcaccaacgacaccattggagggaagctgttgagtgcactacctgccatctgggcctctgttgttggacactacttgactctttaaaagaggttgctgtcagcatcatgtctatttgcactggttgttgagcatcattatggaaggtgagtggcccatgttgacctttatgctcctacaccaacttgagagcctttaactgcatagaggcctttgacttaatgtaataaaataatgactctttccatttcaatgtttccattggtgttttacttgaatccctactatacaaaaaaccttagtctcaatagtttgaacagtttcttctatgtccaaaacactcaatattgagttctcttgataaaaacaaaacttggagttatttaaaaaaatagttcagttggagactccctttgctatctaaggcaggggtccccaacccttcggtcatggactggaacctgtcagtggcctgttacaaactgggctacacagtaagaggtgagtagcaggcgagcaagcaaagtttcttctgtatttacagcagctccccatggcttgcattactgcctgagctctgcctcctgtcagataagcagcaccattagattctcttaggagcgtgaaccctattgtgaactgtgcatgcaagggatctcggttgtgtgctccttatgagaatctaatgcctgatgatctgtcaccatctcccattaccctcagatgggactatctagtggcaagaaaacaagctcatggctcctactcattctatattatgtgagttgtataattatttcattatatattactatgtaataatagcagaaataaagtgcacaataaatgtaatgtgcttgaatcatcccaaaaccatccgctgctccccacgtccatggaaaaagtgccttcatgaaattggtctctggtgccaaaaaatgttggggaccactgatctaaggtgtttaacaaactgtttcttacttttaatcaaaccataccacactgattgacttcagaaatgctttgtttaactagaagtgttcaggacttacgcatgttgcttttatcatcatcatcattataacttataacactaataataacaataaattaccagactttgagaaaaatctcagaagctcaatgaagtgtatagttcataatcagtactaaattgataggcttgtggtttagaatttgtgtagcggaacgaggataaatcagacttcagtatgatttgtgtatttgtttactgtagcagaaatatgatgtcctgaccatgtccccttgacccactctggaagccatgaaagatagtctcattcagagctacagctgtccatggctctgcttgagggtgttccccaggcccagagaaacaccttcaaaggagagagcatggcatagaagcaaccctcatccaacaaaagataggaattgtccatttcagggtcaggttccatcttccatctggtctccaagagggtcctcaaaagactacgcctcccatgactatacaaccttccttagctttcctctcttccttgttccccattcccacttcttcacatggctttctggaattacttcccaagttccttgcacctacgtgcttgtcatagagtctggcatgccttaatgaaacactcgttaattttttatttgagatccattgaatcctcactctgtgccagacatctttcatttatgaaatagtagcttctatttttgtacccatttttgtgataaattaatgtttagagagatgttaaataatttacaaatcacagtgagtggcaaaacctagtcaatttccattcttcagttgcttctattgtttgattgctatcttttacctttactccatgaattcagattggtaaaacaaacaagagactaaatgctgttatactgtgacattctgtaaaattcaaatctctgggtgaattttgatctaagggatatagaggtgtgtcttttttgttgttacacatgcaaagaaggcttctctccactgtacaatatccccttggcttggctgtgagctcatctgctctcatttttgacttcagtttcctcaaatggaaaatgaaatgccttgggctaaatgaattttaggatccattgaaaagctaacttcatacaaattcgagttatgtagtctggtccctccggccaactctacatcgctagctttttgttttatgctgaattctcttgataacaacttctaaagcaaagcttttctataaaatgccagatagaaaatattttaggaattttgagctgtaaggtatctgttgtaatttctcaattctgcaatgtaacacaaaagacaatatgtaaatgaatgagtgtggctgtgtcccaatgaaattatttatgtcaacaagcagcaaagccactagacgtgctcaatgttgcacacagagaacagcctcgaagggcctcacaccaagacatggcagatgaggaatgacaggaaaatttcaaacattgcttgtatcctctgtgtaactgtcctcctggaaactttaaagatatcgctcactcacatagcttctcaaagaaacaaaggataaagaaagcttttctatttctttcttacatgagcccggatggcttctacttgacatggactgttttgtgttgtgtttgcgctgggcttagaggctgagaagagtcaatacccaatgggggtgttgtctggagagctggggaatatataaatattgcatttggaatgtactttcctcttgaacaatcaacctttctgcacaagtttgcttgctaagggtctgttattggcatttttcttataacccctctaataccaagccttttcaaagaacatatgactcagagcaaacattcttttgaggttgaatctggcattcttgatgttattcaaggaatatatttctttgtataaacttttcatagaaaacttcctgaacctgttttagagagcccagaaagtcctagaaaaaaaattgctgcctcatgcttaagcttctagtgggttttgtgaactgagaatgcgtaaacatggtcaaacattatttctgatcccgtttgtactgaaaatctctcctgggctggtgatttgtaattaatgatagttcaggaaaccttgacaactatcttagagttggggaaaagtgatacaggctaagcaacgagctcgttgtcattacatgtaatcaagcagaaattgaacagccattcaccaatgatgctgttcagagatttcacatcaggtgagactttaagaaaatagactctgcagagactcacctccctacctgtgagggagaagcaagggaaggagtggaacaaggtctaaggcagattctatactctcccttttctcctctctcctctttgaactggaaaaactcaggtttacttttttagatattagacagttaggaggctttcttaggaagaaagtgttctactactactaataacaaaatgaatgaatgaataaataaataaataaaatttaaaccactggacaactgagatcttgaattatgttaatcttaagattttaaattttctacaagtaggctttgacccattccacataagaactcatccctgtctatcttcctcttagtatctctctgatctccacaaaacaagtatgaactctttttatcctagatacatttaacagctacatttgatagaagagtagaaaattcttcataggttttccatttacaaggaatagccatcaggtttagaattttgaccatcattaataagtaaactcttcaaaagtcaagcagggctatgttttttgagaactcagccctttagggataaaaggaaacctttagtaaatatccatcggtctattgcatcttggccctaggggcatgcatactcttcgtgttatgtcctcacataacttttatagctgattctcttaaagaaggatagagtcagaggagacagtgaaaaccatgaaagtatgaacatggaattcagaaaaggtgacaatattagtatcaaacatatgtcaggtatggtaggtacctgataaaaatttactgaatgaatgattgaggccatgattatagacactctctatataaagtcttctataaaaagaagaattttgaagcaactatcatttaatttaaatattgggccaatatgtattttaatggtaatgttggaaaactatttccagcaacaaactttatagtaataagcaagcattctgcttatatgaaaatcacaaacagtggaagatattgacttgtacttattgtgcaggttctgaagaaaaccgcatatggtctctctggcaaaagctaatgaatttatgttaaaaatatttttctgcgtgtattgcaagtgttatatacacataattacatgataaatataattctatttgattttccaagtaattaatattttaaatatttgcaaaaagggctatagcacacacaaaaaagagagagacattgaaaaatctgttttaagtataaaacctaagcagttggcagaggagaaaagaaagaaattttttacatctcattattaggattcagtgcacacttatagaagagttccttccccctaaaccctagaattctagcagagaacagagccaaagtgaattatatataaccctgaagcttcatcaagagaatcattggtatttgtttacagatcagtattgaaaacaaatcagcctggagggtttagctgtatggaaggatgtagtttgcttcttaaataacccaagctgtgttgaaaatgttctttctggcctccttatgttctttctgttttgtttctcctttcaaatgcagagtgaatatgattggaatggtctttagcttcagccaagatctctaatgccctatgactggggcacccttgtcttttcccctggtcttccttagcatggtagcctgtgatacttcccaaagttgagttctgggtgactggggacagcctgagaaatgatggtcgaatgatggttgaagtgatggtttctgtcagtcaccaatgaaggggcccattaattttcaaggcttagtgtgagttccatctgttatcctaattgtttgtggagattacatgccagggaaaagagttactgaattaattaaaagtaaatgtcgcttcctaaaactcagcccggtaaacacagcttggggaaatatttccttttgcttgaatgacagctcttggagttaggtaacgtggtgctttcagacatggtttacacctgcagaaacgtacattgctggacagctgtcctgccccctagggtatggatcactgacagttctttcttactgtcaattttgcagagcccagaggcagatgcctacgtgacagcactttaccatccagcatgattgataagacaacccaataaggatccaaagcaatttccttctcttatccttgcctctcaactacatttgcttttaatggacatgagtccaggctggcagttgtggaaagattctgggatgcaatgttttgggggagagcaccaagcttcatttctgatctaaattgctagttggttcttattttaatcttaaatacactgaagaacagttgcctttgatgattttgtcagaactgctagtttctaacgcatctttggcattgcctgcaatttccaaggctaattttaatatatatgaaaaatattttaggattagaatgtgacatcctactaatcattcaaatgaaaaagtagagtggttgaagtcaccattgttctctgtagcaacaataacaagcaattgttatctttactagctttgtcctaccactcctgtgtggctctgagatttacagcaatctacaaatacataacaatcttcgtttcacaagttatggctcatgtttcatattcctttgggcctagcaaattttcattgctggtgaggtctagccattggacaaccaaaaattatgccatttttgaccttgagtcttcattaactaggagacaagtatatatgacatagtggagactgtttaggaaaagaaaggaaaggaaattcatatttattgaggctttataatgtacgattgtagtgggtactgttggtgctctgctcatattccctgagattcctgtttacattttctagtgccttttgctgccttgctaagctcttccttcatctaatggcctgcatctgtggctcagcttgggagcaaggatggcccttgcattgatggaacccctgtgtccaagaggcagagagtgggacgtgcttgagagtttacagcttcataatatcttctagccagattgattagttgagggaggaagacagcctagctctcttgccttaagtcacaacaaaatccagagcataattggcacaagacatttcctttctgcaggatcactctgagactgggactgtgcctgaaattatatccttgcttgacttttctccacactctgttactcctttctcctgggaacactttctcaataaatcacttgctccataatctttgccacagagtctgtttggaacatacttatgctatgccttctacatatactgtattacatatgctatgcctttatgaatactgtatatttaatctgcacaaaaattctgctaggaaattcatgatcagagagatcaattaacctgtccaatatcatagaaggattaggtggacttgaactcaagtcttatcccttaatttattacattttatgctaagcacaggcaagggatatggaatacgtagatccaatttggggaataaaggcatttggagatagattgctcctgcaaactagacctgaataccaacttcttacacaaaagacatcatttgagaaggaaaagataagtgcaggtttattttgctgaaaatatatcaagcataaagagtactctattttggcactggaagcaaatgagtcttaaaaactgctatgtgattagctgggcatgggggtgtgtgcctgtagtcccagctacttgggaggctgaggcagtacaattgcttgaattggggaggcggaggttgcagtgagccgagatggcaccactgcactccagcctggggacagagcgagactccgtctcaaaaaacaaacaaacaaacaaacctgctatatgtcttgtttcatgacggctttttaaaataaagaatactcatgcaatgcataatgatgctttggtcaacaacagaccacatgtatgatgatggtcccataagattataattaaactaaaaatttataccaccttagtgacattgtagacctttctgtgggacaaaatgtggaggtggaagatctgatgatcttggccctggggtaggccttggctaatgtgtgtgtttgtgtctttgttttaacaaaactctttaaaagtaaaaataaagaagtaaaatgaaaaaaaaatacaataagaatatgaagaaaggaaatatttttgtacagctgtacaatgtatgtgttttaagctaagtgtggttattatgaaagagtcaaaagtttaaacaataattgtttataaagtaaaacaattataattagctaacgttaatttattactgaagaaaaaatattcttataaatttaatgtcgccaaaatgtacagtgtgtataaagtctacaggagtttacagtaatgttctgggcctaaactttcactcaccactcccctggctcacccaaaacaacttccagtcctgcaagctccactcatagtaagtgccctgcataggtctaccatttcttatcttttataccacatttttactataccttttctctgtttagatacacaaatacttaccactgtgttacaattgcctgcgatactcatacaataggttgtctatttccagtatagcaatgggctatatcatatagcctaagtgtgtagtaggctacaccctctaggtttgtgtaagtatgctctatgatgttcacacaatgacgaaattatgtaatgatgcatttcttataacgtattctcattattaagtgagacataactgtacttgcgttggaagtggctagatccagtatcacacgcggtctttgctagaaacaaatgaatgtttgtaaacagtaaatcaatcaaatcatcctttgccattcacaaaggaagttaagaagcttggcagaaaaaggtctcgcaaaccctcaacttggatttttttttttacagcaaattagtttaaatcaatgacctcaaatgaagagaattattgtcagcatttagcttgatctttctcattaatgacttccactgtgtttctcccataattagttttataaactagcccaaaaaacaaacatacaaaatgctgggggtttttttttgtttgtttttgtttttgtttttcctttgagacggagtctcgctctgtcgcccaggctggagtgcagtggagcagctcactgcaacctctacctcccttgttcaagtgattctcctgcctcagcctcccgagtagctgggattacaggcatgtgccaccacgcccagctaacttttttatttttagtagagaagggttttcaccacgttggccagatggtctcgatctcctgaccttgtgatccacccgcctcagcctcctaaagtgctgggattacaggcgtgagccaccatgcccggccaaaaatgctttctgtaacttccacaatgaaatattattctcagattatcactaaatttaacccaaagattccattatctcttgctttttttattattattacctttggtgcttggggagttcagagatgccacagatgcaggacagtttatgactcatagcagaagcagtaccaacagtctcatgaggctgtgactggtagcctggcctccttctcccactttcctggagcatccaggtcatacacacagatacttcccagttcccctttggttgaaggagggcttcgaatcccttcactaacatccagcaacagcaatgtaggcaaacaaaagtcctaaggtctgagttctagcaagcatttggaggaatgacttacaaggaattaaagtctcagaaaataggataagttataaatattggctttccatatgtgcattcaactagcacacattaaattccaagtattttacaaatatctacgttatgaggaaagatattttaatccatttcatagaagtctgaggttgagagggattgttaatttgctcactccagtaagtgaaagagttgagattcccagctggaatctccaatctaaactcagtgttccagctccttcacagtgttctgttgggctcagaggtccacagtgaaaaaagcatcctgtgaaggctggcatccacatcattctcatgtttttgagagttcactgcaggcagttttgtcaacggcaccagattgagagtgaagctagaagaggcagacgtgggatagctatatccttggcaataagcatcaagaggctgggcgcggtggctcatgcctgtaatcccagcactttgggaggctgaggcaggtggattatctgaggtcaggagtttgagaccagtctggccaacatggtgaaaccctgtctctactaaaaatacaaaaaaattagctggacatggtggtgtgcacctgtaatcccagctactcaggaggctgaggcaggagaattgcttgaaccagggaacaagggaggtggaggttgtagtgagctgagatcatgccactgcactccagcctgggcgatggagcaagactccgtctcaaaaaagaaaaaaaaaaaaaaggaataagcatcaagagagagtagccagaaatatcaaaagccccagatagccttaatttaagggctctagagttctcctctgcaagaaacccttattctactttatagtactctatttattaaattcattcttatagggtgactaaaatgtgccagatccccaccctcaaagcacttaaaatctaatgagagagacaaacaaactggaaaatttccagttgttataactgttactaatgaaataaacagaatgtgacaatgcagagtgacattcaattgctcttacttgtttatgtaaccactttcactaacagaccatatgagctcctgggagtgatcttttgttttttattcttctttatatttctaatgtctagctaattttagatcctcaataaatgctcatttaattaattaatagatgagtgaacatataaagcagcctctcaatgatgtactctatattcatctgttctcatactgctataaagaactgcctgagactggataatttattaagaaaagagatttaattgactcacagttcctcatggctggggaggcctcaggaaacttacaatcaaggtggaaggggaagagctatgtcttacatggcggcaggtgagagagtgcgtgtgtgaaggaggaactgtcagacacttataaaccatcagatctcatgagaactcactcaccatctcaagaacagcatgtgggatgctgcccccatgatccaatcacctcctaccaggtctctccctggacatatggtacaattcaagatgagattcgggtggggaaacaaagcctaaccatatcatgctccaaagaattgctagaacagaaataagtagctcaaaggaaagcctatttttttccttttgaaactgaagctaaaatgctttcagactttctctctttgatacatttggtgttcccataatgagagacagactatttactctgacatattttctactagtggccacttctcatgaacatcttaaggtgaacaaggttacagctggctattttccagaaataattaaggataattaaaaagaaatatttaatctgaggcttcagaaaattggatttgggtttctcaattggtgttagaagtcaagtttactatcaaaatatttttaaagtgcattttgttttttaccactaaattttctgagttgtctcaaacctaaaattgaaacagtaccttcataataaaaccttccttctttactgcaatgctactttaggcaaagtatatataaaaatgagaatttaaagaaacctatatgatctgtactttaactcagccttgactaaatcacaagtttcaagtaactaaggactcatgaatgggatcccaggcacccaaaacacaaaaacatgatgaaaagtaagaagacgaaaatgactagagtggctttaaaatggcttatccaaaatataagaagcgtttttttttctaagtggaattttttttacgctctcacttattacattattttggttaactgtcttcatgtgataagtgcatttttttgacttaatgaaacagagtaaaaaaaaaaaaacataaaaattaccatgtaagaccagacccatcaatgccttatatacttttattggtgcagtttgtcttctatagcctttaacccccaacatccctttcacatctaccctgcagtttcctagtaaggatttctgggaatgtatatgaatatctgcagatattaagtagtgatgacacatataatagtgaggctttcagatgacatatatgagcatgtgacatgtggtagagatacagttggctctcagtgaatgatatatatttcacacacacacacacacacacacacacacacacacgcacatgaaaatagtttcattggggcttctctattggcctgtgtatttcatgaataactggcctgtcaataataaaaactggcacaagtattgtgtgcactctatctgctttccttgctcaataaagtgtgctattagaggtttctcaggcagtttcaaacttaaagatttaccttcacatttcaaaaaagtagccacgtaaaacaattccaaattaaagtaaatgtgtttggattatggcacaagcaagataaaagaaggatcttctcaaataagttactgtttgtacctcaaaatccccacatctgggaaagacacaaataaaatttcactttctttgttctgtttgttgctgagcacaatttaattgcaatcagatagaaactcatcctaatgacatgcaaagaagctaaaaatgatctttcggtgatgacaagaaactaaactttttcgtttggatagtcactagaagaaaaacaattttggagaaatcatgagggcataagcaggcagcataccatgcatgtctgggaggcaaatattatttatctaaatgaaacacattgtgggtttggcggccaacagcttccatgataaaatcagtgtgaagcagatgtgtgtctcagtagaaccgtgtttgatgttagccctgccacttgctgctgtgatcttatctataaaaataaagacaaaatacctaactttcttgtacaaggatgctgcaaggattggattaggtgacccaggcatgtgcaagcagccagcacaatgcttccatcagggcttgctcagtcaatagcattctgtcatctctggattgatctaggtctcagttttcacatctgtgagatgggagccgccttaagggtgttgggcatttccctatgattcacaaaggaaggtcatccagcaatcctagtactgggtatatatccaaagtaaatgaaatcaataggttgaaaatacactcctatgttaattgcagcactactcacaatagctaagatatggaatcaacctaagtgtctatcaacagatgaatgaataaataaaatttggtctatatacacaatgaaatattatttgaccattaaaaaattaaagttctgtcatttgtgacaacatggataagcctggggagcattaggttaagtgaaataagtcagacacagaaagacaaatgtatgatctcttgcatatggaatctaaaaagttgctttcatagaagtagagagcagaagaataataattaccagaagatatgaagcagagggggaggggagatagtaggcacttggtcaatggctacgaagctacaatttgataggagcaataagttctggtcgtctattgcagtgtagggtgattagagttaacaataatgcattgcatatttaaagctagctaggagagacgtttaggaatgatctcatcacgaagaaatgatatatgataaatgccgatcactctgatttgatcgtgcactacttacacgttttgaaacatcatgttgtaccccgtaagtatgtacaattattatgtgtcaatcgtgaataagcaaaaggaaggtgagaatgtgtctccattatgcgataattttctttgggggaaaaaaaggataataaacattatgcaaccagacagggcagaggtagatttcttttaaaggggagcaatcagagttctaaatgacatgaacatattttaaccatgaagaatttactgtctagtcaaattgatcagttattgccaagtgctttgaaggctctattatctttagactacctggaggaacattccatgtatttccctattctgttacattgtgcagcttatttagcaaacagttacgggaggtgtttttaagcatcaggaggaaaccaggttgtcaagaaagaaagttctcttgacctgtgacaacaaggcagtctctgtcatcctcagatttatgtaatgtgtaaagagattctcatttaaataattccattgaaataaaataatacaaatggatcatgacactgatttatgctttttaaggttatgttttatttgtatttgttttttctgtttgtttgtttgtttgagacggagtctcactctgtcatccaggctggagtgcattggtgcgatctcaacacactgcaacatctgcctcccgggttcaagcaattctcccacctcagcctccctagtagctgggactacaggagtgcaccaccatgcccagctaattttttttttttttgtatttttagtaaaggtgggattttgccatgttggccaggctggtctcaaactcctgacctcaagtgatccacccgccttggcctctcaaagtgctgggatgacagccgtgagccactgcacccagccctgtatttgttttttagatatgtgatagaagaagaaaatagaagcaatgtttttggatgctaatatatgccagaaactgctattttttcagataaataataatatcagaaataaccagttatgtatcaaatagtatgccaaatgctttgcatccattatgtcacttaatcctcatatgatgtgaggaagctgaagcatgaaagaggaaacttgctgaaaagaatcagaacctcaaatctattgaacactgaagctactgtatgtcaccatggtcctatagtatccaaatcgcctttaaaaacttacagcaaaatgccattggtttccattgggtggattaggaatacaatgggattacagcccatgtcataattctggagtagaaattctactccagggtcctggaggctttgacttatcaaacatctgaacattttaggattggccccactcactgctggacaatctgaagagaagccctagcagctcctggaaggggcagtttccagctttgtatccattctgctcactctcatctccactaccatcttctccacatcactgttgtaggatgcatatttgaattctccagtagattgtcctatggactctgttttctcaccaataattacctcctgaacaggctgcacctgaatcctatccctttcccccacaattttttttttcttttgagatggagtctcactctgtcacccagactggagtgcaatggcgtgatcttggctcactgcaacctccacctccagggttcaggtgattctcctacttcagcctcccaagtagctgggactagaggcacctgccaccatgcccggctaatttttgtatttttagtagagacagggtttcaccatgttggccaggatggtctcgatctcttgacctcatgatccacccgccttggcctcccaaagttctgggattacaggcatgagccaccatgcccagcccgtttcccctgttgaacagaatgcagactgactccacatgcttccagagcaagaagtccaaccacctaccctaccagtatttacttccacatcaacttgccaggctgcagccagacccctcctgggactctttctctgccttctcattcccatctttctctactgtctaagccactctgatcaatctgtgaatttccatgtccaggggaatcctcttccacccttcaacactcagggatcttggatatgtagctagagattaggttgggggccacctgctcctttcaccaactaggaagcacctttaaaatatcagaattattatcacaatgcatgcttctttggtttgtagtaaggataaatgagatcttacatatggaagagacaagtgaagggatacaagaatgtaagacatcctcatgattcattaagagatgcatgcattctccagctatggggacgcataatttttgcttttatgtttactttgggaatagtactttattttacttcatgctcctctatgaacaagagatctatagtgtgtcctacagggaaatttaattccctcttttattcttgcaaactagtaagttacaggtttagccataaagaagcaagcaggcatctctgttttcaatgctctctaaaaccaaacaatcctctggggattttggtaaaatgcagattaattcagtaagtctggggtgggacctaatattctgcatttctaacaggctcccagatgatgctaattttgctggtgcatggaccacactttgagaagcaaaaccctagaacattacaagaaattcctaatctccgtgatctgctttgtttcaaaatatttcctttcttccatctttcattagcttttacttatttactcaagccttattcccaagcaaaacaggtctcacccaattagaaagagtcaaagacaaaattgctgacaactctcttggttttctatgctactttcctcttgatcccactgaacgtagatcgtgtagaaatttagatgaaggacacatttaagacctactcttagcacggctgatacaaagtcatagctctccagtacatattttatttattaggaaaattgaatcatggaaaaataaacagagaaacctgaagaggaaaaatatgaatacagcattaaaaacataatttgcctttcaaatagaaataataccagccatttattaagtacttttcttgtgccaggcatctcatttcatgaataatgaaatattctggaaatgaattattatctgagaaatttgataaactcagaccgatcctgccttgttttgtgctatgagacattaatgggattttttgcaactgtgaaatggtaggtatttaaataggagaatgggaaattttaatttgatacggttggcaaggtgtttgatgaggctgtcacaatgacaacaaaatttaaatgcatttattgggattacctgtgctgactgaaatgcaaaagacagaaaaggattcattcacactgacttattttgaatgtgatgcaaatgtaaagagtaatatgatgtggcattatcatgatttctagtaagaaaacactgctgtttggtttgggccaaagaatgaggaaactcatagaggatggctctgcatatttctaaaaccaaaagaggatccagtacaacaaagaatcaaaaccctggacactggttaagaggagggatgaatcactggaatcacttgagtccttagtattttgctgaaatgtattatgcaatatacatccttttctccgcccaatttttgtcctggctgtgaagatagcagttctttatgctttgacatttctgttttgagtttcaaagtcagagtgataaatagagtagaagaacttaggatttagacttttaaataaagccagggaatattctattaaaaaaaataaagagaaactgttgagggacagagttactagctaatttatttatttatttatttatttatttttgagatggagtttcgctcttgttgctcaggcaggagtgcaatggcacaacctcggctcactacaatctctgcctcctaggttcaagcagttctcctgccttggccctgcaagtagctgggattacaggcacgcgcaaccacgccaggctaattttgtatttttagtagagatggggtttctccatgctggttgggctggtctcgaacttccgacttcaggtaatccacccgcctcctggccttccaaagtgctgggattacaggcgtcagccaccgcgcctggtcagttgctagctaatttatatacttttattactgttgtttgttttaagacgaagtcttctgcctgctcacactatacagaatgagcctacaggaacaaaacataagaggtgcaatttgaggactgtcacctctgcctgagaaagtatctccatgggtgcttattaataatgatatattttaaaaagttgtaacagaaagttccaacaggttgaaaacatattatcttctcattgacaaaacagatagcatttattataccatgtgtggcaatttatttggcacattgtggcatccctttttcaaaggcttttcttgccagcacattcatttacctcttcatgatttttttggtcttatgtttttaacaagactgagcagaaagttgaagactatgtgatagatcccttgtcatcttccacagtgcttaccatataatgattggtatagataatcttatggatgtcatgtcttcaatatggcttataatgaaatgatagctaccatttcattgagtgtttcctatgtgatagacattctgatgagttttgtacacatataattgacacatcctacaataatgcagctaaggaggtattatttttaacacatgagaaaatggagtcacagagacttgaatggtgagtctcatttacataaatagaaagcagaagagccaagttttctctgactccaaacgtatgtatcatcacccccaatgctagaaaagtatctaagaagactatatttaagaaaagcctcatattgctggcctatttgattttagtctgttgttttgtcaatccaatctaattccacatgccaaaataattgtcacatgttagtctaaagctaacttcatgtctgatagcctagagcagctaccacattcatttgctaataaaatctgtcctccgtagtctggctttcaagatatttatccattaattaattcaaatctcatctttactcattctcctttaaagctcatcagatcatttttaaaaataagtttctgccaatatcatgtaaattcagcaatcacagtccatctgcaactcccccatatgtggagggggcctagttatatggtgggaaaaacaactgggcttgaaagtttttagtacattcttacagcaacatttcttaattccctgaccaagctgtctacaactgtgcacctatctccacaattattttgtatctttaccctgagttatttttcttcataatactaattaactgtattagtaaggttaagtaatgctacattattctgtggaaataaacaaacctcaaacctcagttggttatcataataaatttttttgtgtgtgctttccttatagcctgatatgcatcagatcttcctcctctatctccttgctgtgtgatctggaacatgtaaactctaaagagaagatgacaagaagagatggaagaggctgttcactggcttggcttgaaagtgacgtgcatcacttttgttcaccagtcaactgaccagaacttgtcacgtggccctaatctaattgcaaataatgcaagggaatgcagatgagcatatgtacatttgttacgcactatctctgtcacattacctcacagaacagtatatatttatttgcttctctcccctctctcccttcactaaaaaattcatttatatggctacagattttgttgtattttccatgccaataagatcaagtagaacagtggctggtacacactggtacacagtgggtactcaaaataaattgttgagtgaaagaatacttgtaagtgattaaagatggccacacattctttgatggttctttcgttgagaagtggcatgaatttatgataactgtgaccaaacaatacggcagaagtgacactatgctaactgtaggcctagcttgcaagagagtagacagtttccactttcttcctagtggggcctatcctgagtccaggaagcacatgctagccacttggggatgctgcatggagagagagagagagagagatctaaacaacccccagctctttcagtaccttctgtttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagtaccttctgtttatcttatgtgaggtcacagacattgcagagcagagatacatagttaccctccaaatccttgacccacagaataatatataacaataaataaatgttgttttaagcccgtaagttttggtgtggtctttaatattatgcagcaatagataattggactaatattcatgatgactgacccttgcatgttcaaccccagtacctacagtctaaactatacacatttattatctctaaggaagaaaggctcaatgtttttaaaagatgcctattttttcgtatcaatgtacaagtgtttctattctgtgaagtctttaccctctttctggtcaaattttgaagactgtcttcttttatatacccagaaagttctgcatggatacatcctgccatagcactcaggacacctgattacttctgtgtgtttattcttttgctgtaatctgtacaaggatgttcactatgtgacacattccaggacacattctcagtgacccctagtcattctacactctttaccttccactccaggtggcaatttgaaacacaagtcaaagagagtgatgttcttacaggcatggtttttaacctatgcccatgaattaaaaacaatttaaaaacccaatctttcactttagctgttgttagttaatctcacttgtatacacattttacaagtgactctcatgcatcttgcagcttatataaccaccaattcagacaccagaggtgacagtagctgctataatatactcattggtttaaaagtgtttgttttcctattagttgcaaaacttttaagggcaggcagcttgagtcccagttacccagttgagataacccacatctgctaatatttttacataaaagtcagtgaaaatataattggcaatgtcatgcaaaactggaaataaatatttactatttttaagccattttggtctataatttaatcacaagatcgttatacttggaatgcaaaaggattggatcatggtggcactattttaaagtctcatttaaatataactaaatgctgcaataggtggtcataactgtagtttgactctaattaatataaaataattggagagtaaatttatccccctgttccatatcaatagctctttggctacaaggcaaaaagaatgtgaacattttctcggtatcaataaaaattagcttaaatatctaagtcaatttagaaatgataaatcagtctccatagttaaagaccaaaattttaaataaccatattaagcaagactcatatatttttaggaatgctctcaaaataaaaatctctcttacaaaccaaaggaaacaaatatagttgaataattctataaacctttcacaaaaatatggcattatggcataaggcaaatatgatggttcaaccagctaagtaaacactgattaagaattaagattgaccacagcaataaggggtattttcctctagtcaatcactcaggttcagaaataccaaatttatcttaagacattctaattaggcaaaactatttgatagatcgagtagttggagatcagaagcatgcatccaattaagaagaatgttattgaatgattttcattcactggcctcttctgttctctgtattttagtttaccttcagcacctcattgaagagagctatatccaaattcaatttattgccccaagacctctttcaaaaaaatggctctggagattcccagctagaaaaacttttctcttctcctaagcttccataacatgcatcagggatttggtatttctccctctgaattgtaattgtttctaggcactagcttctctgccagcctggaagttccttaaggagctgagcccatgttttattcatggttgttcctctgtggggcacagcacttgggcttcccttctttgagcatcaaaaacaagtgtcatttttctttcacttattttcacatccatgtcctcttctaagacctttgcaagtcattcgtagttttaaagagactacatttaagttttgatagataagcaaggtaaatggcaagtccagcagtatagagaaaaacctctttcctgtagtggtatttgttatatattttatctgaattttgaggttcatttgttttcattattgacagatgatttctttgtttgtttaataaaaagcagtaattaattttcccttaattacatgttttacttgccactagctggtgtatctagggattcatattgtaaaaagaaatggaactcattggtttgaatcataatgtgtgggggtatagaggttatttaaatattgtttagttctttttttttattttacacataatagacaattctcaaaatggcagtaaggaaaaaacaactcattctttatattttgaaaatttttggccctgaacacaaaactttaattgtaacctttaatttattaaataaaatattgagcttctaaaacatttgagagtgtgcagcatattgcaaaagatacttggaagaggcaagctgatcttgctccaagaagcttctggttaaatatcaatatgatgaggtttgaaaaaggtacacacaaccactacattacagcatgaagtaagatttaggctgcaagagagatgcaagttacaaatatgaaataagtttgggctgcaaggaaaattgactctggcacaagttcaggagcattttagattagcaaagtagaattgctgggagttcaggtcttagatatttcataaaataactacacctcaatacattggaatttagaaataaagagaccattagtgagattccatttctgcaatattgttttttctaactttgtcccttgttttttgtctgttcctatcctagtataccaaattatcatcatattccctcccatccatgattctagcattttagataaatcgtcttgccattttccaagcgtttggaattgaggtccatgctcatgcccttttctaagaattccaaactccttgagcttaatcttatatcttcttttaatatccctgaactaaatgactctaatctagaatttgtacatatgaccaaaatgacaaaggtacttcccatgaatccccaaacctcctgatattgtatataaaattgtgaattttcctggagttagactacatgactttggttaaatcctcaaaaggagctcctgccccactgaatttaagaagttttagtacttacagaccattggggatatattacacacagaggaggtacaggcaatgtcttacaaaaggcacttgtaatggcagtctttatgatttctaggaagtatgcagaaaaatttcctgaaggtaatggtcatccaaaaagtcaccatggaatctcttctcctgcaaggaattcattactgagtaactccttacctcttggtataattttggcatggagtgaaaggtctaacctctcaatgctgtttccccttctgtacctcctctgtctctttcaggcttaataggatcatctgttgacttgaatcagagtcacattcaaagctgtgaccatcactgacttggcactgtctgtatctgtgtgagtctccaggagaggtgctagtgtctggggctggaagggtgtaggttgctggtaattcagccatgtgcatttgctcatgaatatgtgtataataagagagagacagagggggagaagaagtggagaggggagagagatgagagagagaaagagagagatcaatctgagagagaaagatatgtatacacacacacacacatacacacacacacatatatatatatataaataaaaatctgagagagagatcaaatctgatctgtaattgtatccacttcagaccaaagggaccacacagataaatataaataagtgaaaagattcagtggggtcaatggaaatcaagaagagggcagtcttggcagtttcttctctattctcactgatttcattgattaaacgagaaactaatgtcaagtcagagatatttttatgcaaagctgagaatatggatttttgggtgcaattttccaaagtctatgcattaacaactaattaaaaacatgtaaaagaatatagagcacatagaggaaaattttctcagtttgataaagaatggctacagaaaacgtatagctaacattgtacttaaggtaaaaaaatctagacactttccaattaaggtcaggaacaaggaaggattcctctctccacttcttttcaacattgtgctagaagtgctagctaagaaaaacaagacaaaataggaaataaaatgtaaacaccttgtaaatgaagaaataaaattgtctttgttctcagatgacatggtcatctctgtagaaaatacgaaagaattgataaaaacaactcctggaactaagaagtgatagtaaggttgcaggatacaagattagtttataaaagtcaatcacatttctatgtaccagcaatgaacatatagaatttgaaactaaaagtacagtaccatgacattagtatccaataaataaaatatctaggtataaatctagcaaaatatgtacaagatctatatgaggaaaactacaaaactccgatgaacaaaatcaaagaagactaaataagtggagagctatcccatgcttatggataggaatactcaatattgtcaagatgtaagttcttcccaatttgatctacagatttaatacaatcctaatcataattccatcaagttattttgtagatattgacaaaatgattttgtagatattgacaaaatgtagatattgacaaaatgtagatactgacaaaatgattctacataatattgacaaaatgtcaatattacgtagatattgacaaaagtttatatggagaggcaaaagatacagaatagccaacacaatattgaaggagaagaacaaagttagagaactggcaccactcaacttcaagatttactataattaagacaataaacaaagaggctgggcatgctggctcacgtctatgatactagcactttgggaggctgaggtgggcggatcacttgaggtcaggagttcgagatcagcctggccaacatggtgaaaccccgtctctaccgaaaatacaaaaattagccaggcgtggtggtggacaactgtaatcccagctactcaggaggctgagacaagagaatcgcatgaacctgggaggcagaggttgcagagagcagagatcacaccattgcactccaacctgggagacaagagtgaaactctgtcaaagaaaaaaaaaaaaagaatagacaaagaggtgaatggaatagaaaaaagaattcaaaaatagtcccacataaattagtcaactggtcttttacaaaggagcaaaggtaatacaatggagtataaatacagtcttttcaacaactgcttctaggggtgccagactcaacaaacctgaatactcacatgcaaaaaaaaaaaaaaaaaaagaatctagagacagaccttatactcttcacaaaattaactaaaagcagatcatatatctaaatataaaattcaaaactgtaaaattcctaggagataacatagaagaaaacctagaagaccttgagaatggtaatgacattttagatacaacagcaaaggcatgatctatgttggaaatcattcatatgttggacttcattaaaattaaaacctttttgctctgctaaaggaaatgttaagaaaatgcgagacatcatacactgcaagaaaatatttgtaaaagatacatctgacaaagaatcattttccaaagtatacaaaaaactcttaagactcaacagtaagaaaaaaacaacccaattaaaaaacatgttaaagaccataataagaagcacctcccaaaagaagatatacagatgggaaatagcatatgaaaagatgcttcccatcatatgtaattacaggagtataaattaaaacaacaatgagataccactagaaatgtatttgaattgccaaaatccaaaacactcataacactgaattctggtgaagatgtggaacaacagaaactcctatgcattgctgttgaaaaaggcaaaatggtacaaccagtttggaaaaccttttggcagtttctataaaaactaaacataatgttatcatatgatccagcaattgtactccttggtatttatccaaagaagttaaaaattttgactgcagaaaaacctgcacatagatatttatagtaggtttgttcataattgctaaaactggaagcaaccaagatataccaagaaaccaaaaaactgaaagtacaaaggtggtacatacagacaatgaaatattattcagcactaaatataaatgagctaacaagccacaaccaatatggaggaaacttgagttcctatatttaattcattctccctattactaagtgaaggaagacagtctgaaagggttgcatactgtgtgcttccaactgtaatacattctagaagatgaaaaattatggaaacagtaaaatgataagtggctaccaagggttggcagaaagggataaacaggtgacacacagaggattattaacgaagtaaaaaatactctgtatgatactgtaatgatggacacgtgtcattatacatacatttgttaaaacccctagaatgtacaatatctagagtgaaccctcatataaactacaaactttggggaattatgatgtgtcagtgtaggttcatcaagtgcaacaaatatgccactctggtgagagacgtaaataagaggagaggctgtgtgtcggggtgggtagggaacatatgcagtatctctgtgtcttcctcttcatttggctgtgaatctaaaactgccctaaaaaagtctttcttaaaaagagtccagaacaaagacaaaacgtacatttgttgatatggaacctaggtagtctgaagtttgcatactttcatctatagcttaatctccccacctattttcctccaccatctttgtagtaaatttgaactattctgtatctacaaaaaaaagccttgaaatttcctcacagcttattcttataaaatcctctcagtttacaattcgttctcttgactgttctacttccttactctaccagtcccagattatccgcctccatgatgaatcattttttcttctaggaccatgaaacatataatctctatcatctgcatggcaaattgtcacgtatttgtccactgggtattctttctgatgttgctgttgttattttcacatgttcatgtgtctgtctcatttcccttcattattcattcatgcattcattcatttgccctacatacacccattctatattctgcatccttgtgcttgacactgaagattagaccacagagcaagactctttccatgctttgtaactcaccgtaagtgtacttctaatacacaagatcaatcaagaaggctattataaacctttgtgacctgaaaccctctgaaggctgtttgtattgatatggtggtatggactgaatgtttgtgtcccctcaaaatttatatgcagaagccctaaatccaatgtgataatattgggaagtggggcctttgggagataattagatttcgaggaagtcatgaaagtgggttcctcatgatgggattagctcccttatgagaagagaacagagcaggctctctctcagcctaaggtctgactgatacacaactggtattcagaaatatttattgtttggttacttattctcatttgcaataagttataacatattaacaatatattcctacatttcacagtgtggatgctattgttgttgccactgggtatctatgtgggaactaattgaggaccacatttacaatgtgcccaaattgtaaatgtaggagtatctatgtgggaactaattgaaccactgagtatctatgtgggaactaattgaggaccatgtttacaatgcgtacaaatcataaatcaattagttcatattgatttacaaacaaggaagaaaaagtatttgtttacattgatactgtccatgtaaacttttttcaattcaaaagaaacacatagttctgtcataaagtagattttctatcccttttattttctgagcttatttcagaaagcacttgcaatagctttgcacagttcagcatttatgaaggaaacctttgttagcctaaaatgtagctgtaattttttttcaaataatttctacacaaagcttttacaccttatttgattacctcaattttttcccaatgagtgaatacggacttaaattcattttttataaaaagcattaaccattgtttcttgtaattacactcagtgagagtcgaacaatagtgtctccatttgaaacagacttttgttataaggttgaaattgactttaaattcttttgaaatggccccaaaataacacatagcacagtggtcgtctttgaggtgagaattatgtgtcttattattgagagattggactgtgtttcacagaaaaattctcatgacctactaatgtgtttcagtcaattgttctgaaagcacaggataagaattgtaatgataatgatgaaaatatatgaagacattgaaaactgaggttctcattgttatagcatgtcagttatctttatctcattcaacagcatattttaaaatgtcacactgatttccaaagaaggaagaaaaatttaaagagttcaggcaatgcatgctagttaaacttattgtgataatacattcatagacattgaaaatattggacaaagaatgaaaaaagagagaagaaaagcatgcctaaagatagtcagtgcttggccagtatatatcttagggcagaattcaatgactcaggttgaaaaataaaaacctatctagatattttgggtttcttctctctctgattaatcaaaatacaacaaggcagaaatgaggaaagatgcaaacttttagtggccaatgaggaaatataccttgggggcatatatggtgagtccaaagattggtggccaagaataatagaaaaagaagagatgcagtagaacaagaaggacatatatcatcatttatctctgctccatctctccatttattctgcaagtgatgggcgcaaaggaagaaaacctgtgcaggaattaaaggggcagctctacagagtcactgagagctcattgtccagacttggataaaaatgggttcctagtcctgcctcagtgagtattacttgtgtccatgatcatgtcacttactgcttctaaactccatttgtttcacctgtaaaatggggataattatggtccctaaatcatagacactggagatattaaatgatataatgcagaggaagaggactgagtcaatgtctggcatttactaagcctccagtagagcctagccataaggtttctattataattaaaaacatataaggaattttaaccattctttgataagtttagttacccaaacttttttctataataagctgtcctataacactctagaactgaagacatgtatcctcagccacactatgtttgactcagctgtagagagctgtcttgcccaatgactgactgtggtaggaacccctgattcttctgattaaaaatgatattgtttgacagtgtccccacccaaatctcatcttgaattgtagctcccataattctcacgtgtcatgggagagacccagtgggaggtaattgagtcatgatagtgaataagtttcatgagatctgatgattttatgaaggggaattcccctgcacacactgtcttgcctgctgccatgtaagacgtccctttgctcttccttcatcttccagcatgattgtgaggcctccccagccatgtggaactgagccgattaaacctcttttctttataaattacctagttttgggtatgttattattagcaaagttacacaagataactctgacaccacagaactccctgaggtgttgattaagactttgtgggtctaaaaatatccgactttttcctctgagcaattgtacttctgtactccctcttccagtgacgttaatctctaatcctgaatgctgaacttctggagaacccaatctggttcattagcgccaactattcaaattgtcttcagggagctagtgctttccttctttctcacaaaattacatggcttacattttctgctgctggggaaccctcagccatggatcctaaggccaaggatggacggagaaattccctgacagtctattctaggaccatttgaaaaagagggacccgagaccacaccagagaaggagagagttggggacctaagtcctggggaaaggaataacaggaattagggcctgattactgatctgggcctgctatttttaaggaaagtgtatttatgggatagaggggagggggaattattcatcatgatattagttatagattctagagatctagagaaataagcagaaaataaaaactacaagaagatgtttaacctagaaaaatgaataattactaattaatttatatgcatctcttttcatttcattcatttatcactttagtcactcaacacaatttaactgagaaattatacaacatgagacactgtggtagactgtgtggggtgaagcgttgactgaaacctggcccttgtcttaaaaaaagaaaaactcacatttttgcctcattatcttccataacaacataaatatattttattatacatataccagatacattttgtttgtcctaatcaattctgtcttatgggaacaacctatacctaaaaagattggagatttgtatcacataaaatgataaaaattttgtttcattattttatagttatagctcagaagttccagtttcttggtgttcttttctggtattagaggtacctgcttaaacttttacaataaagaatgaaagcattggctaaatgcattcccagaggctttgaataacaactctggcaactggtttgcccacaaaattgagctgatttataacagccttaaaaaattaattaaatgcataatatatattagctgaataatagactgagttgggaaggtttttcagtagataatatcttgcggttaacccagaattttttccctacacaaaattaggggcataaattactattttatttttagagaaactgtaggcatcagactggatgttacaaaacagcttcaataagacatagaaggccattgcattcctcagttaaagggaatgtttgttgcaaagataattattcttttcacaaacacctgtgcttccttttcaagtgcagagtaatactaggcagtggctgcccagccaagaacattacctgctccggttgcatataaaggagtcatgtgactgatttcagccaatagaatgctcataagtaagaatagttaagaagtaatggggaccctttccaacttctctccctccaaatgcaagcatctagctaagtactcagagtcctgaagagattgctgaagcaatagctgggaagagactcactccttaaagaattgtttgaaagaaaacttctcacgaatcagaaacacctgtttagactttacaagcatgagctatctccttctatttgtatatttatttgttacagcagcaagcattaccttaaagtatattgaaagcgtgtggttgaatgtgaaaatgttgtacggaaagatagggaaacatatgctaatgacaaattgggtccaagataacgagcctgttaaaagatatgcacgtcttttaaatgatcgaatagaattcattataacattttattcccagtaggaaaaattagatttctaaaagaatggtagcacttgtggcaagatcttatgttgcaagtacagtagatgaatgaagagaaactgcttaacccccattctcttaaagattaacatttataatttgtaatttgcctttttacatgtgcatctgtattaacacatgcccatctgaaaatatattcggagctttaaatatatactatagggttttgtcaagaattattaaaggagataggatcacatttattcaatgtgataaataattctagaccctcccatttggagaagaaaagaaacaaaaatagtttactggcttataatatgcatgcataatttttctttttcataacacaataataatgatacaaaaaacactataatcctatataagcaaaagtgcttagttctgggtcaggcaaattgaaagcaaggtggtgagccagactcagcaccatattgatgagaatcacaccttaatagatggagaagcaagtagaaaggggtttagatgatcttacataacagaggcttttaatcaagctggaaccctgcctacctctaaattattacataggagaaaaagacttttattttaaaaattcaattgtattttaggacctttctgtaacaacagtgtgatctatgcctaaacattatatgatccaaattgtgccccttgaaatttcttatgttgaagccttagttcccagtatctcagaatgtgactgtatttggaaatggggcttttaaaaatgtaattaagttaaaatagagtctttagggtaagccctaatttaatgacttgtgtcctaataagaaaaggagattagaacaaaaacaacacatacagagggacaaccatgtgaagacacagcaggcagatggccatctacaagccaaagagagagccctcagaagaaatctatcttgttcacatcttgatctttgacttccagcctctacaattatgagaaaataaattgctgttatttaagccacccaatatgtggtacgttgctatggcagccctggaaagtgaatacaaataatacataattcatgcattcattccttcaacctttacttagcactaattttgtcatatgtcctgtgctaatggatgtagatgacaatgtaaattaaattctcctatgtcctcaagcaaatcacagacaaatggataagaaatctctccttccattatacagtggctccttattatggaatcttgctatttaaataaaatatattccatcagtgataggttaaatggtgttctcccaaattcacatgctgaagtcctagcctctagtctttcagattgtgactgtatttggaaattttgtgactatagatgtaattagttaggatgaggtcagattggattaggaggccaacctaacccatatgactggtgtattagtcaaggttctccagagaaacagaaccaatcatatatgtatgtgtgtgtgcatgtgtgtgtgtgtgtgtgtgtgtgtcacacagagattattataagaaactggcacacaattatagagtcaaacaaattgcaagatctacatggtgagtctgcaagcaggagagccaggagagctggtgctatagtttttgtttgaccctgaagccctgagaatcagcagagccaatctttcaacttcagtctgaaggccagcaggtgccagacccaggaagagctgatgtttcagtttgaatttgaaggcaagaacaattcccctttacttgagggagggtcagcctttttgttctatttaggttttcaacaaattggaggaggcctgcccacattaggatcattaggaggatgatctgttttgctcagcctactgaatcaaatgttaatctcatcacaaaacattcttacagacacactcagaataatgtttgatcaaatatctgggcaccccatggcccagtcaagttaacacataaaattaatcatcaaaactgatgttcttataaaaaggggaaatttggacaacaaaaaagacaagcatatagggaagatgggacaatgtcttttaccatgagcatatcaggctaccagatgctagggagaggcagggaacagctcccttacagccctcagaaggaactgactctactgacaccttgattttgagctcccagaatcaaaattcttgtcttacagtaagacaataagtgtctgttgcttaagccacccagtttgtgcaactttgttatggctagctttaacaggttacaccatctattctacactaaagttaaatattttaaattctggaatcagtaaacaaaccctgctacttgccatttggggttaggggagtaagctatgtcagtccttcacagtttcttttcttgatatctttttatcagcaattcactgatatacccactattctttcaaccaacacttattaagtgtcttcatccatatctcttgtattgtgctataaagcttatgataaataccactgagcagaggatgctaatcacagagttaactgtagtgtgattcttggggatatgtcaaacaatgaactgagactgatttatctttatgaattcaagttgcttatatcacaccagtctaaagaaaataaattccaaaaataatatcacttttaaatcaaaattgagagacaagaatatcaaagagactggatagactctaacttttatcaaaaaatgatgtagataccagtgggaaaaaaatagaagattcttagaagatggttattttagagatttgaggggaagtaaagagaagagagaataaaaaaattcttaatcaaatgactcaagtttatattaataatatgaaatatttttaattatctcacaaactgaatacttgcatccgagtgtccatgtcaaggaaacaattttgtgtttaaacctctgcagatccaaagattcatactaacatctcaatggttgaaaactgtcattgaaaggaaacttgaaaataattaattcttaaactgcttaatttttcacttttcatttcacggtttgtcactaaaatagtaattattttttcttctcttgctaatccaacaatttcatactgacagcctttcactgggaaatttactttcatattactgctttacactttaaatacaaatatttttcaagatgaaattagatatgttggcaagaaatatgatctttagttaatgatttatgtttctgctttggaaaaagaaatgtctcttacatatattatacagacaagtggcttccaaacattctgttgaagtgttcaaagggaatgctttatgattattgctcaataaaaatagtgtgttggcatttttactcccgttacctcacaggaaaaaaaaaaaaagaaaatgctgcaatagtatgtcataacaattaatagtatgtacactggattttggtagaccaaactataagtcctggattttattttaccaattctgtggtttaggtaagtggtttaccatttatgctatagttatcttagctataaaataggaccattggagtatacacctctgaaggtgtctggaaagactgaataggaaaattcatggaaagaacttatatagaagggaaataaataagtgctcaataattgttagttgaggctgtaataataattacttattgagtgctattcaagggccagggattgggctatggagtaaagacataaaaatgaggaattcacatgtttctgggacctcgctaaatgtattgtgaaattaaaaaatggcggtatatgtgaaatcactttgaaaaagaaaaaaactctacataaatacaagaaaaatctctcaagacagatagtagccaatgcacaatttaattccaaaacatgggtcagcttcttactttggaatgttatagttttaatttaaattattgccaatatttaatattaaatacattgaccacctgttcattaattgatgaactcaattatactatcacttatgcattctccaaacatgtacaagtgtccactctgtcatgggaactccccagccattctggcagccctatgttttgtttctcaagcacgtagtcacacctttcttcccctttaatgtcagcttattttttcttcttggttgactttctaggggtgttctatgacacgctgagcagcttgtggtgaacgtacaagtgtcttaaaataatcgagtgtccctacactaccaaagtgttaaatctaattgaagaggccaccatgaaaatgagtatctggcacagccttggctgggcttaggaaagcaacaatttgagaacctagatgttggcagatgaccgtattaagatctactggaactgcatttaaagatttcatatgcatgacaaagcccatctactcctacaattggtttgatttacagcccaagataatggtgcttctagtatctcaaatactaaaaaaatcatatttaattgctttaattcactattaatcgattattataatgtactgctaaaggacaattctttctaagttctacaagcacaaataacatgaccatattatctttccaaattgctgactgtacaatattgtgggaatataaactacaatataatccagtggtttagtagctgttactactgtgaaaaaaatatttaggaggtcattatatcatagattggtatcatttgtctatatatatatatatatatatatatatatatatatatataactcaattttattttaaaaaatagtaaaagcaaacatcacatgaattaagaatgtattttatactttaagatttattttcaaaatgtgaatgtaaatcagatcttcccatcacgaccccagaagaataatgatttattttaatatttgtgattttaggatttagatactacctacttaccaagatactcacttgtaaaatatcttttaagaatatagaggcaaaatagtgtagcatagaaaacacattgaaagttcatattaatagccccttcgagtttttatagaccctagggtaaaaacaaacaaacaaacaaacaaaaaacctccatcccttgcctcagttctcattcatgtggtttgtttataggatcaacaacaccggtgggaaattttacagtattcttcttattgtgggcagctctgatggctccaaggttctttcttgtgctgagcaggaacctatttactgtggcttccattcagtttcagtattccttttagggctaaggaaaataattctcagaagaaggccaagcaacatggtcaaatagaagcacccagcaattatctctcttctgcaggaacaccacattgaccaactatacacacacacacaaaagcaccttcttaagaatcaaaaatcaggtaagtgatcacagtagctggttttcacatcatattgaggaaagaggcactgaagagggtagaaaagacagtctttaatcacctataccatccctccccccatcccccgcatccccctcatcccctggcatgtattgccatgcggcactgagagaatgtctgcgcctggggaagggagaatgcagtgattgtgagacttagcattggaactcagtgctgtcctgtcacagtaaaaagtaacatggggtggaagtcagccttcatccacagagggagcatttagaccaaccctagccagaggcaaattgcccgtcccagttgtcagaacatgagtttcagcaagccctgccaccatgggcaaaaggactctggggtcctacatcaacttgaaaggcagtctaggccatgaggactgcaatccctgggcaagtcctggtcctgtgctgtgctgggctcaaaggggccaggggacttggagtgcatgtgacctggtgagataccagccgggatgcatgagggatgcttgcaccaaccctcctcaaccctaggcagtatagttcacagctccaaaagagactcattccttctgtttgaggagaggagaagggagaacaaaaagaactgtgtcttgcaacttggataccagctcagccacagtaggacagcgcaccggacagagtcctgaggccccattccaggccttagcactcagatgacatttctagacacgcattgggccagaagataacctgctgccttgaagggaaaaacccagttctggcaggattcattatcttctcgctaaagaacccttgggccctgaataatcagcagtggtagctaggcaatacttgcctctgatcttgggtgagactcagaggtgtgctgacttcaggtgagacccagcacattcctggctgtggtggctatggggagagtctccttctgcctgaggaagggagaggaaagagtaaaggggattttgtcttgcagcttaggtatcagctcagttacagtgagatagagtgccaggcaggccctagggttcctgattccaggccttggctcccagatggcatctctgggtctgcccggcattaggaggaactcatcatacttaggaggaactcatcctcttagaaagaactcatcacactaaaaggaaggacataagcctggataactttgccacctgctgagtgtagagcccttggtccatgagtgaaaataggctgtagccaggcagtagtcactgcaggccttaggtgagacccagtgctgtgcagtcccagtggtggtggccatagggatgcttgcattacccctctcccagctccaggaagctcagcacagagagagaccctgtttgtttggagggaatgtggttctgaatcattatttaggggaatattgtctgaacatggtctactttgaagtttctcaccctttctcataatatgtcccatcaacataaatattatcaagcttcatttcctataattttcattatgttgcccaaatgaaaatattctgttgcaaattattgaaatgtaaaattttgtattaaagtataaattatttgttaaaatatttaaaatatgattggttattctacatacagaaatgtctttggatatctcagtatgttctcatctttcccctgtcctatcattattcttccagtgactcatgccaagaattgatcacaatgctccaagggtggtctgaccagcagggaactgagcagaactgaacatggcttcctgttttctgtacccaatttctttccctttttctggtaccactcatgtccacatcataatcatcttttgcctgaacaatctcaacaggctctgacgtggtcgtcctgcttcccccatgaatcctgagtgtttaccttccacttagtagctaaagggctcttttgaactcataaagtttatcaagtcatcacctcctcaaaacgttctatacacttcccataataatgagcatgaaatccaactccataccctatgtggtctatataatctccctttcctcagtctccccttattccattctctcttcactcatgaatttccagccaaaattttcttctaatgtctcaatgattaggtcaagcaggctccacacagtagggtgtgtgcactgattgtctttgtgtggaatactttctctctctctgcatatttacatggctgtccttttcttgtcatttagattttagttgatatccctcctcttcaatgaggactttcatggcctccaaatagtaagtagcttctttcatcaacttttatcatgtcaccctaaatgtagtaatagtacttgccaccataaaatattcttatttatttgtttattgtctagctgtctaatgaggtaagacccacaacagcagtaatcttaataattttatttagaataatgtttggaatataaatattgttgagtgaatgaatgcatgcatgcatgaccacagtatagatgtgttattgtatatgaagctattaagatcaaagagtttgagcctgggcttgaattgctgatctacatttactatggtgagtctaaacaagttacttaacctatctgtgcctgagattgtacatctaaaaaaggggcagataaaaatgttactttcttctcaaggttattgtaaggattaaataaataaattgctctttgtaaaatgcatagataactactgtataaatgtagcaataaatagtagtacaacccaatttttagaattttggcagccacactattgactcatattacacctaaagtataatgtaaattctctaagtttttttttttaacgtgtgctgctttgaagtctcacctctatatttttgtgcttacacagctgccttttagaagccaactacaggattttatattggtccgctttatttggtttcattcagcacatcattctactctgttgacaatgctgaaggttttgagttattgattaaatgtcaccttggatatttgaaaccaggacttcaatctaaaaatctaagctacttaactcaagtgacctcagtctagaggactctgagtattcatggggccagtgtgttgtcttctagcagtttcctttcacttgcccggagaagaggcctgtgaaggctggccctgggtctgtaaaacacataccagaagtgggagaggacataggttaaaagcagattgacagaggaggatcaaagaagccataagtatacctcagctgacaatgaccaagcttatgggaagaagatacagaaaaatagaaatttggatgtagagcaaatcttattttttcactttttattttgaaataatgatagattcataggaaattgcatagttagtacaaagaagttctaagtacccttcacccatttccatcttacatagtacttaacaccaaaacacgactttgacgttggtataatgtgggtgtgtagttctgtgtcatattagcaaatgtgtagatttgtgtaatcaccactataattaagataaaaaatattctatcaccacaaagatctctcccacactttccttttacaatcacgtacccaaaccctcattactcctgactctgggcaatcactaacctcggatccaactcgataattttatcactgagagactactatataaatggaatcataccagatgtgacctttcaagattggagttttcactcaatataatgcccttgtgatccatcctagctgttgtgtgtatcaatagtttgctcatttttattgttgagtagaattccatgctgtggatgtaccagagtttgtttaactgctcacccactgaggcatattttggtcttgtttttggcgattaaaaataaactgctgtgaacaatcatgtgcagattgttgtgtgtctaggttttcatttctctgggataaatgcacagagtacagttgctgggttgaatggtaactgtatgtttagatttttttttttaaagtgtccaactagtttaactagttttttgagtggtgtactggcttatatttccattgtcacagtttttactttagctgttctaataggtatgtagtgatatctcattgtcatcttaatttgtatttccctaatgtctggcaatggtgattagcttttcatgggctcactggacacccatattttctttatgattaagtatgtgttcatatctttttctcattttctatttgaattgtctgtttttactgttgagttttgagattttttttttttttttttttttttttttttgagacagagtcttgctctgtctcccaggctggagtgcggtggtgcaatctcggctcactgcaagctctgcctctcaggttcaagcaattctcctgcctcagcctcctgagtagctgggactataggcgccggctaccatgcacggctaattttttgtatttttagtagagatggggtttcaccgtgttagccaggatggtcttgatctcctgacctcgtgatctgcccacctcggcttcccaaagtgctggaattacaggcttgagccaccatgcctggcctgagttgtgagtttttaaatacattctagatatgaattctttgttagatatgtagtttatcaatatcttctcccagtctgttgcttgtcttttcatcttctcaacagggatttcaaagagcaaaggttgtttaattttgatgaaatcccatttggttattttttcttgtatggatcatgtctaagaactcacaagtcccaggtcctgaagattttctcccatgtgacctgctacaagtttcatagcattacgttttacatttaaatcaattgttcattttaagttaatttttgtataaagggtgaagttaagattgaggttcattctgtttgtttacctgttgtccgatttctcaagcatgttttgaaaagattattattcctccattaagttgttactgtttctgaacctttgaccaaaggtggttgggcaaatttgagcgtctttttgggttctttgttctgtttctttaatctgtctttctgccataccacacaggactattgctatatactaagttttgaagtcatgtagagtaactttacctacgttattattttgcaaagtagttttagctattgtagtatacttggctgtctatacaatttttagaatagttttgtctatgtgtatatatatctgttgggattttatttatttttttatcttttgattttttaaattatactttaagttttggggtacatgtgcacaatgtgcaggtttgttacatatgtatacatgtgccatgttggtgtgctgcacccattaactcgtcatttacattgggtatatctcctaatgctttccatcgtccctccccctaccccacaacagtccccggtgtgtgatgttccccttcctgtgtccaagtgttctcattgttcaattcccatctatgagtgacaacatgtggtgtttggttttttgtccttgcgatagtttgctgagaatgatggtttacagcttcatccatgtccctacaaaggacatgaactcatccttttttatggctacataatattccatgatgtatatgtgccacattttcttaatccagtctgtcattgatggacatttgggttggttccaagtctttgctattgtgaatagtgccgcaataaacatatgtgggcatgtgtctttataacaacatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcatctgttgtttcctgacatgttaatgattgccattctaactggtgtgagatggtatctcattgtggttttgatttgcatttctctgatggccagtgatgatgaacattttttcatgtgtctgttggctgcataaatgtcttcttttcagaagtgtctgttcatatccttcaccctctttttgatggggttttttttttcttgtaaaaaaaattttgtttaagttctttgtagattctggatattagtcctttgtcagatgagtagattgcaaaaattttctcccattctataggttgcctgttcactctgatggtagtctcttttgctgtgcagaagttctttagtttaattagatcccatttgtcaattttggtttttgttgccattgcttttcgtgttttaaacatgaagtccttgcccatgcctatgtcctgaatggtattgcctaggttttctcctagggtttttatggttttgggtctaacatgtaagtctttaatccaccttgaattaattttcatataaggtgtaaggaagggatccagtttcagttttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtgccatgctgttttagttgctgtagccttgtagtatagtttgaagtcaggtagcatgatgcttccagttttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccattatttgtatcctcttctatttcattgagcagtggtttgtagttctccttgaagaggtccttcacgtcccttgtaagttggattcctaggtattttattctctttgaagcaattgtgaatggaagttcactcatgatttggctctctgttattggtgtataagaatgcttgtgatttttgcacattgattctgtacctgagactttgctgaagttgcttatcagcttaaggagattttgggctgagacaatgggattttcgaaatatacaatcatgtcatctgcaaacagggacaatttgacttcctcttttcctaattgaataccctttatttctttctcctgcctgattgccctgcccagaacttccaacactatgttgaataggagtggtgggagagggcgtccctgtcttgcgccagtttttaaagggaatgcttccagtttttgtccattcagtatgatattggccatggggttatcataaagagtgcttattattttgagatatgacccatcaatacctaatttattgagagtttttagcatgaagggctgttgaattttgtcaaaggccttttctgcatctattgagataatcatgtggtttttgtctttggttctgtttatatgctggattacgtttattgatttgtgtatgttgaaccagccttgcatcccagggatgaagcccagttgatcatggtggataagctttttgatgtgctgctggattcagtatgcaagtattttattgaggatttttgcatcagtgttcatcagggatattggtctaaaattctctttttttgttgtgtctttgccaggctttggtatcaggatgatgctggcctcataaaatgagttagggaggattccctctttttcttttgactggaatagtttcagaaggaatggtatcagctcctccttgtacctctggtagaaatcggctgtgaatctgtctagtcctggactttttttggttggtaagctattaattattgcctcaatttcagagcctgttattggtctattcagggattcaacttcttcctggtttactcttgggagactgtatgtgtccaggaatttattcatttcttctagattttctagtttatttgcatagaggtgtttatagtattctctgatggtagtttgtatttctgtgggatcggtggtgatatcccctttatcattttttattgcgtctatttgatccttctctcttttcttctttattagtcttgctagcgctctattaactttgttgatcttttcaaaaaaccagctcctggagtcattgattttttgaagggttttttgtgtctctgtctccttcagttctgctctgatcttagttatttcttgccttctgctagcttttgaatgtgtttgctcttgcttccctagttcttttaattgtgatgttagggtgtcaattttggatctttcctgctttctcttgtgggcatttagtgctataaatttccctctacacactgctttaaatgtgtcccagagatactgctatgttgtgtctttgttcttgttggtttcaaagaacatctttatttctgccttcatttcgttatgtacccagtagtcattcaggagcaggttgttcagtttccatgtagttgagcagttttgagcgagtttcttaatcctgagctctagtttgattgcactgtggtcttagagacagtttgttacaatttctgttcttttacatttgctgaggagagctttacttccaactatgtggtcaattttggaataagtgtgatgtggtgctgagaagaatgtatattctgttgatttggggtggagagttctgtagatgtctattaggtccgcttggtgcagagctgagttcagttcctggatatctttgttaactttctgtctcattgatctgtctaatgttgacagtggggtgttaaagtctctcattattattgtgtgggagtctaagtctctttgtaggtctctaaggacttgctttatgaatctgggtgctcttgtattgggtgcatatatatttaagatagttagctcttcttgttgaattgatccctttaccattatgtaatggccttctttgtctcttttgatctttgttggtttaaagtctgttttatccgagactaggattgcaactcctgccttttttttgttttccatttgcttggtagatcttcctccatccctgtattttgagcctatgtgtgtctgtgcatatgagatgggtctcctgaatatagcacactgatgagtcttgactctttatccaatttgccagtctgtgacttttaagtggagcatttagtccatttacatttaaggttaatattgttatgtgtgaatttgatcctgtcattatgatgttagctggttgttttgctcattagttgatgcagtttcttcctagcatcgatggtctttacaatttggcatgtttttgcagtggctggtacaagttgttcctttccatgttcagtgcttccttcaggcctcttttagggcaggcctggtggtgacaaaatctctcagcatttgcttgtctgtaaaggattttatttctccttcacttacgaagcttagtttggctggatatgaaattctgggttgaaaattctttctttaagaatgttgaatactggcccccactctcttctggcttgaagagtttctgctgagagatccactgttagtctgacgggtttccctttgtgggtaacccgacctttctctctggctacacttaacattttttccttcatttcaactttggtgaatctgacaattatgtgtcttggagttgctcttctcgaggagtatctttgtggcattctctgtatttcctgaatttgaatgttgacctgccttgctaggttggggaagttctctcctggataatatcctgcagagtgttttccaacttgattcaattctccccgtcactttcaggtacaccaatcagaatcttatcaatatcctcatctcccacatgaatattctctgacagttccagcccactctactctctcatcctttcctgaaatgttatggctcttatagcctgtgccacaaaattaggcatttaattttatattgtcttgttttgttttctaattatgtcatggatatattcttttccatgctagattgtgaattcttggcaaggaaccaattttcatgcttttctgtgtctcttttcagcatttagaaaatatggacatataattatactcaataaaaattgttaattgactgaacaactttcctaggttcattgtaactcttcagttctatgacattaaagtacagagcacaaaatggccaacaattcgtatgttaattatctgaaatgatgaaatcattcaatacacctgggcagctatgagaaatgtcgttgatggtgtgagcagtagtggtgcatgcaagggccatccatcctaaacagctctcatacactttgagttttggactgattcatcagttatctaccgagtagattgcttaaaaagaagtgttgggggctgggtgcagtggctagtgcttgtaatcccagcaatttgggaggccaaagcaggtggattgcctaaggtcaggagttcgagtccagtctggcaaacatggtgaaaccccatctctactaaaaacacaaaaaaattagctgggcgtgatggcatgagccagtcatccaagttacttgggaggctgagacaggggaatttcttgaaccagggaggtggaggttgcagtgacagtgagctgaaattgttgcactccaacctgggcaacagaatgagactctgtctcaaaaataaaataaaataaattaaataaataaaaattaaaattaaaaaaagtattgaggttttattgctccatttatttgtgttgtcatcaaccatttggtatccattgcctcgaagtaaatcaaggtgatctaaagggttaatttatgattcttggaaaattctataatgttcgcttatctcatttgaagaaaaagtaaaagttaaaatatttgaagaagttactactcagactataaaaatcatgtagtcttgccttctcattctattctcaaggttctggaagttaaataaaaatggcttattataatgctggtctttttactaactcataagaagttcaaaatatgtagtttttactcctctacctgctagtatttagataagcacctcaaaaccaatattcacgtttcataatcagagtgccctagttaaactccagatttgttacttactagctatgtgactctgagtaaatcatgtaatttctaagagccttcgttgtctttcagataaaataggcaaagccatatctacttctcagtgttcttgcaagaattaattagctcatataataaatgtgcttattactattcaaaaaacatataaaagcataaagagtacattactatttatctgggaataatcctttttattataatgtaataattgttattacaattattataaaactcatctttttgagtagggcatacattattgttcaaaatgtaataaaattggtgaagttttagaactggagcaagatgtcatagtagcgtaaaagagggcacttaacaagacctgggtgccagaaagtatatctaaattagaagatttttaatatgagttttagagattttaaggaagtcattatcagggcttctggagacaaggtggcttgggcacatttatattttagacatatctagcaggagggaacatggttgagcagagggtgatgatgacataaggacaccactgaaaggaatttgagtaaaatgatgacacatattaggagagatggggcagatattactcatttgagaaaaagccacacttcaagagtgactggaaagagtcagggagtgcgggaaaagagtcaaaggtgatccttaagtatctagtttgggtaactaggatagtgtggctccaacctgtcgtaatcagcttgggctgctataacaaacattatgctgagtggtgtaaacagtggaaatttatcttctcagaattctagaggctccaaagtctgagatcataaatgtcagcatggttggattctgttgagggccctcttcttgggttgcaggcagctgccttcttatatcctcatattctcagagagagagagagatcatctctcttgtgcctcttcttataagagcactaattccattcatgaggactctaccctcatgatctaactatctcccaaaggcccacctccaaatatactttggagattaggaacttaacatataaattttgggaagcacgacaattcaccccatagcatacccattgagaagaacaatacaagaaaatttggagttaactaatttgaggagaaaatgatgagtttacattaaatcaagacgaacttgagatgttttaagagggaactgcttcttccctactacttatatgttctgccaggaagagaaaattctgctagtgtggtacttctagtttcttctcttgtccctgtactcactctgcccctggggaggcgaattatttatttggttgttcaaactggggagagtgactcttctgtctagaaacagccttcctatggagagcctgggctgtcctctttcactccatgctttacatctgtaaattctgtaggagcctccctcttggaagccaaattgccccacaatccaggtcagattgtggttcatattagccactgcacttacccttgtttgaaagtcacgtgccccaacttggttatggcttggtctctatccttcctgcttatttttcagctttctcagtgttgaggcaggaatgaaaggtatcctttatagaaaggactctagagattccaacaaggccacttttgacaacacatctatgacccattttttggcatctcacacaattggctcatttaagtttttcaatgtttgagctaattaaaatataaatatgatgtatgttttatatacttccaaaatgtaataaatgctcagtaagtatctgtggagattatatatttaaaattagttgggaaacataactatcctactgttaaacattttttagagagatttagagatattcatttattgaactcctatttggctggtaatttgctcagtgtgacctgccatcctacactttttacaaactgccccacttctcattttgccaaaccagattgcctttctcttaatagctccttctttcttgccactgaacctaaactcatgttctgagcagtaggcaaaataattaacagacccacaaagatgttcttaagtcccagaccctgtgaatatgttatgttacatatcaagggggaattaaggctgtaaatggaattaaggttgctaatcagttgactggaatataaagagattattctggattatccaaatcagttcagtgtaaccataatggttcttataagtgaaaaagggaggcaggagagtcagagtcccagaaggatatgtgataccaggaagcagaggtcaaaatgatgcaactgctagatttgaacacggaagcacccacaagccaagtgatggggatggcctctagaagctgtgaaaggcaaggaaacagactctccttctagaaaagaatgcacattgatgacatctgattttagcttagtgaaacccatttcatatttctgaactgcaaaactgaaagatagtaaatttgtgctgttttaagccacgaggtttgtggcaatttgttgcagcagtaacaggaaacaaatacattctgcaactcatctcctgcattttccctgagtggccatttataaatacatagactctgacccagcctggccagagataaatcaggctcctccacctctccaactgctagctctgtgatcccaggcaagttattaaatttttacatgactatttcctcacctataatatggggattatcatgacaccatccttatagggatgagttaatagatgcaaagtcctttggaaaagtgggcacataacaaacactatagaagtgtacgctaatattttcattattatgcttacctctacaaattattttataaatcagttcaaacgccaattcttctatttccttttggaacaataagatctttcttccttaaatttatagagtactttaccttaacaatattttatagcatgtgttcgttattatgcttacctttacaaattattttataaatcagttcaaatgccaattcttctatttcctttttgaacaataaatttacagagtactttaccttaacaatgttttatagcatgtgatattttaattcttatttaatcactttcatacatattgaatcctctctcctaagatataagatcttgtaaaaattagtgatatgcattttatatatttactttatttattctaattttgttattcctatactgtctaggccagtgttttgcatatcataggtgttcaataaacatatttgaactaccaatggtgttttccacttgtgctaatttcaagaaacaaacaaaatcattcactattcaatgggcaacactctacagaaagaattaataaaacagaagaatgaataaaaacccgaagagtagcatgaagtctatagaaaatatcctccacaagtatgtagtgggattcagattctttttttcactttcactctagatgttcaactttaatttaaataacatgttagatcaagtgtgcttttataaattagttattagcccataaactgtcttatatagtctgctctgaaggttatcactttaagaggcatgatatactgtggggactgaattttagtactgtgcaaagacctgattggaatgaacatttctgaacttctagagcctctccagtaagaatgcagttgttgctgtgaaattgactttaaaagaagcttctgatgacaaggcctagctgattattgtttcagagatgaagtgaaaaaagagcaaacatagttaccatagaaataaatgtattaagttctaaaattaacattcttattagtgattatgcccatatttttttgatacatctacagttaatctcaaaactttcatcatgggtatggggttatacttcctggtatgacccaagatgtgaaactcaattaaggtcaaatgtcattaacttcggtagtatgttttaaaattaacctcaaaacggccccaaattttgttaaaactatagaagaagaaattatttattaagaaggtaagaaaagtaattcttctaaactatgcaatcatttatttattggctctgataagaataacatttcaaatggttgtgttttctgtcagtaatttgaagttctagtataatatttttatttaattacatgattacaaaacaagtctttacttacatcatatgcattatatgccaaattaattctcctttgaaaaggccaattgctgataagagcaatgaattctattgaatagctcactgaattctgagagagtaattaagaaatttttatatacacacagaaacacatgtggctcacacattaagatgtagacgacaatctttcaagataccatctaacaaatggaggaaatatgttttcagcttgcaaacttcaaagctctatgtccaataatgagataaatcttcatttctgatggtactaatccaacactgaaaaattaattctcctttgaaaaggctaattgctgatgatttcgcagaaaagaggtctattctttttagtggatatgaattgatcctgctaatgcagaacctgactttttcagattcctttagcctttagtatgagtgaatttttaaaatttctcttttgttgtgttagaaataaatataatgattttttctcatgctgatttttaagagtttaaaggaaaacaacagctgatagctcattaaggctcatgagacaccactaagcatatacaactcccattttgaggctgcataagccaaacactttcaattccactagaaggtgtcattagaagtacttaagcaaagaaagctactaggagcaagaacaccccagagaatttctgtaaagactttgatgcacccattgtcccatagtttaaaatgttgtatcactcaagcagcaacctcattaacagatcatttagattatcatgagttatgatgaactcaagcctctgtagtattttcttcccaacaatttgctttattacagcaatataacagacatctgccttaaagagaagtcttactttccactctattggatgccactgaaatttacagtgtctggggcaggaggaagaagtaataaagtcttacagggaaaaaaaaaacttgttacctaagggcaatatcagaaatgatgagaaatgagataagccagtaggactaattcaactagaactgaagaagctggctctgaatctgatttgctctcctccaaaagaaaaatatgctcatgataacaataactaatgtgtacttaatacttttgaggaaaatgactatgtggtgctccaaactatgtgcaacattctgtgccaggttattctatctatctatctatctatctatctatctatctatctatctatctaaaatttatgtatacacagaaatataacattttacataagtagtaaagtaactctgtattttaggtcttatcattgccatgttaaatatatttccagagtaatatagtcagtaagttgtttaagtggggtttggatgcaggtctctttggtttcaaaggctgcagtctttacccctcatcatattgccttgcttttgttgccttcttcacttcttttgtctctgtttcttattcagacaaaggtgggaattgactgtaggtgaagactcttctttggctaattggtttattttatccctaaggaagattcctattcttgcttctggtctctcttctccctctctctcttcctctctcttttttttctctccctctttccttccccctcctcagaaaatgactagactttacctttgcaatagactaaatcatagcccctaaaagagatatgcctaggtactaatccctgggagcttatccataaaaaatgtatttgcacacctgatgaaattaaggatcttcaaaggaggttcttgcattggattatccaagtggaccctaggtgaagtcacatgtatccctttaaaagggagggagatctctgtctccctctgggcttctcagtctagagggaggcagatacacacaagagaagaggcaatgagatcactgagtcagagattggagttaggcatccataaaccaaggcattcctggaattaccagaagctggaaggcaaggaatggattgtctcctaaagccattaaaaggaatgtgaccctattggcacctttaattctggcttctggccttcctaactgaagagataataaatatctattgtgttaagccaacaagtttgtggtagtttcttacaatagtcacaggaaactagcacaactctcttctttgaaattctggaattggcggcaggggaaattgcatgtaaaagcactgcatgtttacctctggctctgtgaaatcacaggaagtacagttaaattctaggaaacacaggggcatttttacctctgcacaaatctataaagctcctgagggtcctgcagtctttttccaccctgatgtctcccaagacagccttctgattgctgagatatagcctacattgaatagatatttgttgagcaaatcaacctgcttctgctgtggctccagcaggactggaacatttcaggaaagaataaaaggtcatttctcctgagttaagtgttaattcttgctttgaatgtcagtggcgtgctaacacctgctctcacatgtattttaggtccatcagcgtatcctaactagaaggccttgtgactagcagaaaagaaaatgtaggtgagccatgcaatgatggacgtggactgctctcagggcgcagtgacaattatgacttagtcatcaaaggtgaattgatacaaacacttgaacatatcttaaattagattgttccaggaatccttaaaatgcaagagaaatggcaatgatggggcagtggataaatctaaatgacattacgtgggctatgattcctttctccatgccatttggaaagttagaagaaatcatattaggcctgagaatagactgggtgcttctcagtgtgtatcctttacacccagagtgccaatcatctaggatgcaccggttctgccatactggggatatacagtcaaagtccattcttactagctggtaccttgcaggaccagttgtcaaatatttttaacagcaccttattcatgcatttttttctagaatatatatgaactttttccatccccagtattgtggctcccctcccatccctatttagatcctcatctctcacttggatgcctaaaatagccacttcagcccctctttctacataatcatctcctgtaatttattctcaacacatgttttcttgaagccttatccaaatatatgattcctctactaaatgcatgaatacataaagaaaacaaacatagaataatttactgctactgacttcatgtcattccacaggattaaatatagatcccatattatacacactcatattacacttatataatatctatattattatatatctacattaaatacacatatattctatacattaaaagaccctcacaatttgaaccacattgtatggactcaatgtttgtgccccacccccaaattaatatgctgaagcctaaaccccaatatgatggtatgtggaggtgggatctttgggaggtaattaggtcacaacggaggagctcttatgaatagaattaaagctcttataaaaagagacacaagagagattctctctctctctgccagttggccatatgaggatacatgcagctatcggcaaaccagaaaggccctcattgaaaacccaatcatattggcaccccgatctcacacttccaggcaccaaacctgtgagaaataaatgttggttgttgaagtcattcagtctatatagtattctgttattgcagcctgagctgactaagacacccatctaactctgcagccttctgttcctctctctatactgaagtctatttcattatttcatatgtatttctcatggctttttgaaatcaccagacaatttcctgcctccatggttttagagctgatgtcaaatgggaacaccctggtgacaccaagccaacagatgtcaattctggttggtcaaggctgctgctctatctgattagttggtttgggttaccctaaaggcagatcctgagacaaggaatttcatataaatagtttactaaagacataatctcaggaaggaggagtgagaaaagcatagagactgatacaaggatggaggaaagccaatataaatgtattttgacaaagttactgtgagaaatcagaagttcacacgtatgctaggacatgtgagaagcccacctatgaaatgaccttataatcatccagaaagataaggcatctatccttccatcattggttaggtttgttaactccactgcatttccaggttatactgatgaacaagatgagggaattccaaccacatcactccaggccaggaggctgaatcagaaagataagtaatcgtccatttcctctgctccctcactgtggactggaacgtggatatggtggtggggagccaggttccgtcatgtagatatagtggagcaaaaaagctctaaaaatctggatccctgcatgacctcatggaacagagtagttgtatttttttcatcctaccacccctggagtgcctaacgattctatattgtcaagtgaaaattatttcagtctcattctggtggctaaacccaaatcttaattaatattattctctcatgcatctgtcccatgctgtttactttcactgcactctagttccacttcctgtcagactctattgcaattatctatttaaatgcccatctccatcgttgcattgaaagttcttgatgacagccacggtgccatttctgaaccctgagtgcctggtaggtattggatttacaagaatttttaaataaaatttaaaatgtaattgctccaacagtaaagctgtaatacatgcaattaaaaatatatgatacataatcaccactcactgggctgcttactgtactttttctcatgaagtataatttgacacaggaaggttaatgaagcatttcctgggaaacatactttacatataacatgactccaagatgtgtttgtaccattcttgtattctttccctctgtcacaattagagaggtggttcttctcctagccaagaaaaattcttctatctatgctatagatcttcttttttctcctaccattaagaccctaagctcttttttcgattccttcaagttctttctctctgttggttaaaatctctctaaaacaatcaaagaatgctacctagtcttcacatgttcctttaagtggcagactcttttctttccctctttccctccctccgtccctcccttctttctccctctctttccctctttccctttccttctttctttctttctccctccctcccttccttttccttcctctctctctctctttctttcttttttttttttttgagtcttgctctgtcacccaggctgaagtgcagtggcacgatctcggctcactgcaacctccacctccctgattcaagtgattctcctgctttggcctcccgagtagctggcattacaggcatgcaccaccactgctgggtaatgtgtgtgtgtgtgtgtgtgtgtgtgtgtgtgtgtgtgtgtgtgttttgagacagagtcttgctctgccacccaggctggagttcagtggcatgatctcagctcactgcaacctccacctcttcagttcaagtgattctcctgcctcagcctcccaagtagctggaactacagccatgtgccaccacacctggctaattttttgcatttttagtacagatggggtttcaccgtgttagccaggatagtctcaatcttcctgacctcatgatctgcccacctcagactcacaaagtgctgggattataatttttgtgtttttagtagacatggggtttcatcatgttggcccagttggtctggaactcctgacctcaggtgacccacctgcctcggcctcccaaagtgatgggattacaggcgtgagccactgcacctggccaggtgacagactcttaattatcctgtgggagtcaaggtttcataaaagccttcacttgctgtctgcattttctcactcacttcacaacacaattccaacacaaccaggtttatatcgctcttgccaacatttcacaaaattcaatggacttctgttatcatacatatctgtcagcagcactcaacaccactcaatcctcccttcaaatgtccactgtgtcttcatttctgtttattcttcttttctctccagccactcattctgaatgtattttgctgcctcttattccctcagtagacatttaatgataaaaattctcaacatttatttcaagatacgcttcccttctcactcaatataatgtcgctacttatttttttccaattctatggcttcattggtcatgccacaaatcctaaatgttcatcgcctggacagaccttgcttctgagttccaaaaatgtctattcaaatgtgtactgagatgtctcactggcaactcaaaaccatatgccattgtatctgaaatgttggcccccttcaagactctcaaccaagaaattgcaccataatttacctcattgttgaagccaagaaaatggaaatcttatatgatttctcattctgccaccaagaatggccaaccacactgaattgcctggaactgaggcgtcttgtgggaggtagaacttttaaagctaaaattaagttagttggttaccttccaatctggctcctggctctgtgcattctatttcctaaatatctcttatatttgttcaattatttccattttcatgacctctgctactgtctcttgtacagggatccgtacgttcattcttgcccttcatttctcaccctacaaatgctttctgtacacaatgaccacaagatatcaacaaaaagcaaaacttatgatatcaatctcttccatccttctcattgtctatgagataagacccagcaatatctgggccctgcgtgtctcctcagactcatgattcattatttcctctgtgttccagcccaactaacctttccatttcttaaatgtgccatgaaacaggcctggaattactcttccctactccttcttcctattaactcctcatcttttgggtctcagaatcaatgtaatttcctaaagatgttttgccttctctccctagacaagatcagacacatctttttccccccgcccatatcaaactgcactgttccttcacagaattcaacagcattcattatttgttcaatatccatcttcccagccacactagaaactccatgaagcaactattattgctttattctcttaccactgtatatacaataccccaatcagtgcctagaagcaaaaaacttttgtgaaatgaataaatattttgttatagaatatttccttatgtgatatcatgtcctattataacttcagataggttaactaaaaatataactctattaaggaaagaaataaggccatggcccctcctaaaattttagcaagttttaccatatcccctttgtatggtttggatttgtgtccctgcccaaatcttggattgtattctccaatgttggagtaggggcctggtgggaggtaattagatcatgggggtggacttcccccttgctgttctcatgatagtgagtgagttctcacaagatctggttctttaaaagtgtttagcacctccctctttgctctcttcctccttctctggccgtgtaagatgtgtctgcttctcttgcaccttccaccacgattgtaaatttcctgaggcctccacagccaggcttcctgcacagcttgtaaaactgtgagtcaattaaaactcttttatttataaattatccagtctcaggttgttctttacagcaatgtgagaatgaactaatacagcactgaatctaagatgtcatcaatggtaacgtgtcattattttaagtataactaagaaagaaaaacaatgttgaaaaataagtcatgaaacaccttgactgaaagacacatccagttttcagatatcaaaaagtaaaaaactgggaaaggccacaacttccacaacaaatcttgtttgctcacttctctctctactgggtggtccctccttggtccatggagtatcacctcattcttgggccattgcaacttccttgtattctcctaactagtatcttctcttgtatacttgaacccccagcttctttacatttcaaccagactgatcatttcacaatacaaacctgatcaccccaaaatgcaaagcctgatctctggataaccctatactggttgtctattctatgacacatcacacacatactctcccttgttttctgtcttcctgacatggttcctaaaatatgccagcttctttcctttatctggaatattctgcgacttgctgtcttcaatcgttccttctgctccttttcattttatagtgttcattacaaatttccccttcccagaacgatgttctgtgattctgtcactgcaaatcagtagcccctctcccctgcccatgccgttagaatttttcacacgtatagcctgttctcttccctcaccgagctcatctcaagttctcattacacatatttttttgtgtgtttatttgcataacgactgttgcttccactgaactttgagctccataagggtaactatcagcatgatgtgccagtgccatataccacagtgtgacacagatagattatttattgaatgaatgaggaagtggaacagttacactttgctgaaacaaagacaatagaaaattcaatgcacagccctgagaggaatctagaaacaagtctgcagctaaaaagaagcagcatatacccccaaaacttaggtaggtgtcataaccacatcctcataaccatgtgtgttctcaccagatacacctgccttctaaagactgtttaaaaacaattcacactaaaggtactacttaagaaaaataggcccttccatcttaaaagagaaaagtttttatgtattgcattgtatgttcctctcaaatattttaaaattattttaagtcacagattgtttcataaacataattttgtttttccaataaaaagctttgaaaaaactcagaaaatatttttgcaaatgtggacctcaatatcatttgttatgtctcattttgaaaaataatcaaatttgaaataaaatgtgttttagaaggttagaaatatacacatattttctcttcacacgtttgtgaaaaaaattaggtaaatgactaatgagaaaatactactagactaaatttacaaagaatacagagcaaaaacagaacaatcttaatagaatcagtgccaattacatctcacatttcaatggcagtgaaaataaatgtgattttgacatatgaaattgtgttaggaatgtttttatgtagaggaaaatgttatcatccttgggggctttttgttcaaccaattttcaactttctaatgcctggctgtgccttgtgtggaatcagggaagtcactatttctctgtccttgaatactgctcatgcatcattctcataaaaatatatatttgcccatccctgaattcatgtgtctcttcattcactcagcatttatggagaaaattttatatgacaagcacttggctagcttctgtatatacaaagatgaataattctaggattaaaatatggcaggaaaaataaaaccattaacaagtaaattctgaaagttaaatgctaataaaaaagcagtagacatatgtacaaatattgaatgccattttatatctctcttcattttccagagaagggcattaaggcttaagataacaaggtaatttcatggagatttcatacctaacgaatgaaaagactagggcttgaattctggtttctcatttcataactagtaaatccctttaccgagtgttgtcaaacatatgtcatccattttatgtatgaaatctcctttcatactatgcatcttcaccagtttgagctgctataacaaaataccatagactgggtaccttataaacaacagaaatttatttctcacagctctggaggctggaagtccaaaatctgtgccagcatggtcaggttccagtgagagccctatttcatgtcacagactgctgacttctcattatatcctcacatgaggaaagagcaagagaactctgtggagttccttttataaagacaccaatccattcatgagcactccaccctcaagacctgattacctcctacagaccccacctcctagtattatcacattgaaggtttgatttcaacatacgcattttgaggggaaaccaacattcagtccataagaccatgaaaaataacaatttttatttctgttatactgacaaggaaaccaagactcagataggctcagcaactggccaagccacacagttagtaaatggcagcaccaaaattcaaactcaagtttgtccaacccagaaacttctgcaatgtctactatcacgagcttcctctctattccagttcccatgtatctgtgaaatgatttaattatcacacattactagcatttgttgagcatttatatgtcccaagcattccttaaagatgcttccaagaatcaagttatttaattccaaaaaaaataatatgtaggtactgaggtaccatcctaaggtattgaggtattatcctgatagcacaccgagaatgctatcgggtctcccaaagatggagaattaaagaacgaatgtctctatattcctcagcaggagtcagtctaaaaggaataatccaccagccagagtatatgccatttttagattacagatacaatccactataagttccaaacccagagtggtcaatattgcttttcttcttttatatctgttctgttttgcaaaatatatgttatggttaaagaatgaacttgagtgagctgccctgaaatgagagccatttgtttaaagttctgtggtgactccttcttccttcccacctgcatccccaaccacatgttgagattcctggaaatatgctccttcataagggtagagagccaatgaggaccaaatgatatgttttcctttccctcagcttcaagggctcaaagtcccagatgaggggcagggagcatactccatgacagaaataaacaaacagccaggtggcccaagtaatgactagccaggtctctggaaactcctcaagaactcaccggcttgcagcctaatctgggaacagtgttgtacatgactacatataatataatgtgaatagtactactacagacaggtggaccaacatgatctgaaagcaccagttaagaacacatacagaagtatttgatacaaggtaaaatctatcattcaaaggcatacaagtactttgcaactacgaaacacctctaaaaaactaacggctttgagacagtgctatacataaagataaataatttaaaagactatatgtacattctcaaaagtttgtccttgcacaaatcacttgcttcccaccataaacacttctgagacccttcctaataaaaccattaaggttgagcaggcaacattgtttagaagaacaactgtgagttgtacatgacccttcataaaagcagagactactaaacatcattagtaggcgatattacagcatcttcaaacccagacataactggcaccaaatttgcaggaaaatgagttaccttcctaatagcccttaattacaattacaatgtgactttactcgtattccagtaatgaaagcatttactctcattcctcatctgatttaaagggcaacataagctgaatgcaagataccttataaaattagaaaagcaattgaacaaactttaacactgtgccccaggatgacaagaaggaaacttcttcagaaacaagacatcagtgtatccaaaaagttctttggatttcacagtttgtaatcccagggaaagaaatatggaaaaaaaaattgagaactcagttatttggccaagctaaatcaaacacatgtttataaatctaatttctatttcttagagataccgagttacagatactatatgggctaatgataacgaagatgacaaaacttctttttagtaaaaaataaccattagctataaaaattagaaaatagagaccagtgaaatataaattgagaatagggtataatggatattacaacaattaaaagaaaaaaagctggccaggcacgttggctgacgcctgtaatcctagcactttgggaggccacggcgggaggatcacaaggtgaggagatcgagaccatcctgactaacacggttaaaccccatctctactaaaaatacaaaaaattagccaggcgtggtggcgggcgcctgtagtcccagctactcaggaggctgaggcaggagaatggggtgaacccgggaggcagagcttgcagtgagccaagatcacgccactgtactccagcctgggcgacagagcaagactccgtctcaaaaaaaaaagaaaaaagcttattaaataatttaatttagtgctataccttataaaacattgtaaaagaaattccaaatcaaaatgttatttaaaaacaataaataacccctctagttcaaaacagaactaaatatttatgaactttttagaggaatagtgcttttctgcatcaaagaagtgacaacaaaggtagtggcagattcaacacagaaaaattacaacttcctcatacaatgaaaattttacctaaagcaaagaagggattaacatctaatatgacaaaatgttaagatctgaattgtacacaaagtgcacagaaattgataaggagaagctctggtgacggctagaagattgccagagatgtgaaccatgtgtgggaaagctcgactgggaggataatataaaacaagaggaaagaaaagtcagatttagagtgagaacattgtcaataagaattgccagggtcccctagatggttccaatgagcctcgtctcctgataatcacatccttgtgggagggggtctcacattgacttgtgtaaccaatatgttactgcagaaatgaagttatatgacttctgaggctaggttaggaaagattttgcaacttctgccgtgtcttttcttgtatcacttgctctggggaaaggcagctgccacattgtgaggaaactcaagcagccctatggagaggtcaatataaaaataactgaaacattctgagaactgaagcctacatctacttgattattgtacaaaggaagaaattgaggcacagagattaagagccttgcccaagtttacacaggaaggaagtgccagatctaagatcaggtttccagagcctgagtccttaacctttacatgatactgccttctccatggtagaaatagaatgaaaaaatgtttacaattgtatgaaacataacaacaaaaaagaaatgctaaaattcagaaactgattggatgtgaaggcaaggggtgcattgaaatggctttagtttttcaaatatggataacaaggagaacagtagggttattaattaagataaagatcagacactcacagtttgaaaagtaaaatgtgcacataaatgtatgcatgtgtgatcattcatgttgtttagagagtaaagtgatacacagggaatgtagtgagcaagctggtttgggattatcagatttgagcttgcccaggcaagaagaatttcagagaagcttcattccactagcatatattaaaagatggcctctttcaaatgataatgtgtatactactttccttctggagattcataaaacgttggaaatttcctcactccacttaacctcttttttgcccgtctcattcttatcagtcactctaggcatggatctaatctaaattatttttaaaatatgactctttaaaaacacatactaattaagtagaattcaataaaattagtttatttaaaacatgaatgaaataaaaataattagactcgttttgcaataactagaatataaactactatgcagagtgcaaatgctatgtttcattagtgtgtaagagaatattctaagtttgagaagtgttttatttctctaaaattagaaaaattttagtttttctttagtttttcttctcccaaacatatgtgactttatttcattttaatatataagtctttttaataaatacatttctgtctatggggagctcggaaaaggcaggtgcagcaggtgttatttttgaagagttctgtacacgttcacatctgcttagttgttatgcactgctgcatgtaatggccaagaaaatccaacacaaatgctgaaaccaaaatccccaggaaaccagcagaaacgaaattggacaaatcctaatacataatgtatatacttcaatatcctattgcatgtggttacaaatttgaatatggcatatagcttatctttgtattttactaaaataaaactaaaacccacaaactatctggggagattaaatttaccgtacataaaaatgcccaagggaatgctgcattccttttatgatagagggactaggcaatgaccagagcggtgcaattaaccagactgttggtcatgagttgatattattgttccactagccccacttgattcactgccaagctcatcccataccctcatttgttagagccactccatctttgctctatttcacttgcatagaaaaaaaattcagatcctgaaaatcaatatgttgttgaattctaattttgtcttattttacttgcagatcttatctcacttgcagctgtttacattttccatattgtgttaatagtcaaattttatttctaaacataacctaatttttgctgtgcaggtaacaggctgtttaacaagctatacctactttagggtccttcagtttttttattctgtttgactatgtaatgtcttcatcaaatatctcctcatttgaacatcaaaaatattattttttattatagcaaccaccaagtatcatgatacaaagcactaaagttggttcttcgagaattattttgaaaatagctcttttaaatgtagaaaataaatttccttgtgtttcttattttatatactaaatatattcatttacaatatatatttggttttcacttcatatgttcttgcctcctttgaataattttaatttaaagagaagacacaatttccaaatgtttaataaagcctcttagaattatacttcatgcaatagataaatagctatgatacctgatcagaaaatctcatgagcagtaatgactgaggagggctcctgaaggatgctatgtctccgtatccttccacttccccaaatatacaattaatttaaagctggacagacaatgggacaaagtttcagccattaaactccaaatccctcaaaatttaaaaacaaaaaaatttatcaacaaaacaaatagcacattttaaaatttaaaactaacttaatatatgactatacaacccaccaattccatttctagctatcttccccaaagaaatgaaaacatacattcacaccaagacatgtacagagatgttcatagcaactttattcacaatagccaaaaagtggaaacaggccaaatgtccatcagtgagtgaatggataaacaaaatgtgtcatagccatacaacagaacattactcggcagttataaaaaaggacaaagatacatactataacattagtgaaactcaatcatgttatgcttggtgaaagaagccagacacaaaagaccacatacaaagatatcattttttattttgtttcattttattgtgccttgcagataccacattttttttacaaactaaagatttttggcaaccctgcatggagcaagtctataggagtcaatgggagtcattctgaacagcatgtgctcatttaaagtctcagtgtcacattttggtaattattacaatatttacaactttttcactattattacatctgtcttggtgatctgcgatcagtgatctttgatgtggctaccatcattgtttggggcaccataaaccacactcagataacatgttgaacttaataataaatgtgtgtgtgtgttgactgctccacagaccagacattctccatctctctccctctcccccagcttccatattccctgagaaaaaacattattgaaattagaccaattaataatgctacaatggcctgtaaatgtttaagggcaaggaagaaccacccgtcttttagtttaaatcaaatgctagaaatggttaagtttagtaaggaatgcatactgaaagccaagataggccaaaagctaggactcttgggccaaacaggtagccaagttgtgaatgcaaaggaagagttcttgaagaaaattaaaagtgctactccagcaaatacaccaatgataagaaactgaaacaatcttattgctgatataaaggaagttttagggctctgggtaaaagttcaaactagccacgatattcccttaagccaaagtcaaatccagaataaagtgactttcttcacttctatgaaggctaagagaaacaaggaagctacagaagaaaagtttgaagctaacagtggttgattaaggaaagaagttgtctccataatataagaagcagcaaatgctgatgtagaagttgtagcaagttacccagaagatctagctaagaaaattgatggagggggctgcattaaataatagattttcaaggtagaccaaatggtcttttattggaagaaaatgttatctaggactttcatagctgtggagaagtcaatgtctggcttcaaagtttcaaagtacaggttgactcctttgttaggggctaatacagctggtgactttaaattgaagccgatactcatttaccatttgagaaatcctagtgtccctaagaattatgctaaacttactgtgtttgtcctgtttcccataggtgcaacaacaaagcctgaataacagtacatctgtttacaatgtgacttactgaatatgttaagcctgctgttgggaactactgttcagaaaaaaaaagattcttttcaaaatattactgcttatggacaatacacctggtcattcaagagctctgatgaaaacatataaggagattaatgttgttttcacacctgctaacacagcatccattctgtagctcatggatcaatgaataattttgattttctcatgtaattatttaatacaaggacagacacttctcaaaagaagacatttatgtggccaacaaacatatgaaaaaaagctcaacatcactgatcattagagaaatgcaaatcaaaaccacaatgagataccatttaacatcagtcagaatggcaattattaaaaagtcaaaaaccaacagacactgacgaggctgcagagaaaaaggaacgcttttgcactattggtgggagtgtaaattacttcagccattgtggaagacagtgtggtaaatcctcaaagatctagacgcagaaatatcatttgactcagcaatcccatcactgggtatatgcccaaagaaatataaatcattctattataaaaatacatgcacacacatgttaattgcagcactattcacaatagcaaagacatgaaatcaacccaaatgtccatcaatgatagactgaataaagaaaatgtggtacatataaaccatggaatactatgcagccataaaaatgaataagatcatgccctttgcacggatggagctggaagatgttatcctcagcaaactaatgcaggaacagaaaaccaaacaccgcatgttctcacttttatgtgggagctgaatgatgagaacacatggacacatcggggggaacaacacacactggggcttgtcaaggaggtgggggaagggagaacatcaggaaaaatagctaatggatgctgagcttaatacctaggtgatgggttgatctgtgcagcaaaccaacatggcacacgtttacctatgtaacaaacccacatatcccgcacatataccatggaacttaaaaaagttgaggggaacaaaagaaaaaagaaagaaataaatttcttaatgttatagctgccatgaaaagtgagtcctctgatggatctgggaaaagtaaactgaaaatcttctggaaaggattcaccattctagatccaattaagaatgttcataattcatgggagaaggtcaaaataacactaattggagtttggaagatgttgattccaacccttgtgaatgactttgaagggttcaatagtttagtggaggaaggaactgcaaatgtggtagaaataacaagagaactagaattagaagtcgagcctgaatatgtgactgaatatgttactgagtttgatcaatctcatgatcaaactacaatggatgagaagtttcttcttctggatgagcaagaaaattgccttcttgagatggaatctacctctggtgaagatgcagcaaacattgttgaagtgactacaaaggattttgaatattacacaaacttcgataaagcagaagaagggttttgagagtcgactccaattttaaaagttctattgcaagtaaaatgttatcagacagcattgcatgcaacggaaaaatcttttgggaaagagtcagtggggaaacaaatttcactgtggttttaagaaattgccacagccttggctgggcacggtggctcacacctataatcccagcactttgggaggccaagccgggcagattacttgaggtcaggagttcaagaccagcctggctaacatggtgaaactctgtctctatcaaaaaatacaaaaaattagcagggcgtgctggtatgtacctgtagacccagttacttgggagactgaggtgggagaatcacttgaacctgggaggcagaggttgcagtgagccgagattgcactactgcatttcagcctgggtgacagagtgagatgctgtctcaaaaaaataaataaataaaaataaattgccacagccacacaaccttcagcaaccatccctgatcagccagcagccatccacactgagatcaggccctccattagcaaaaagattatgacttgctgaaggctcagatgatcatcagcatttttttggcaatcaagtattttaaaaattaaggtgtgtacattgtttttttagacataatactattgcatatttaataggcaacaatatagtttaaacacaacttttaaatgcattgggaaaccaaaaacttcttgtgactatatttattgcagtcatcaggagctgaacctgcaatatgttcagttcaataggtatgttgttttgtatgattgtttgtgtgtgtatgtgaagaatctgtgtatttattgatttatcacctaaaaccttcttaaaattttatctattgagggggtacaagatttcttacatgcacatattgcgtagtggtgaagcctgggcttttagtaaacccattacctagacagtgaacattgtgcctaataagtaatttttcaaccctcatgcccctgccatcctcccacctactgaagtttccagtgtgtattattgcgctgtatatgtccatctgtacgcattgttcagctcccacttataagtgagaatatgtggtatttgacttgctgggttatttcacttaggataatggcctccaggtctctccatgttgcttgcaaaatacatgattccattcttttttatgcatgagtagtatttcatgttgcatataaattttatatatatatcatttctttatatataacaaaaatgtatataaatgcataaatatgtttgtgtgggtgtatacacacatacacacacaccacattttcttccattgatggacacttaggttgattccaaatctttgtgactgtgaatagtgctgcaataaacataagagtgcaagtatatattcttttatttatataaaatatccaaagaagggcagatatgtagagacagaaagcagatgagtggttgcatagtggtggagagtgtcaatgggagtgactatatgcacatgagatttcttttgaagctgatgaaaatgttctattattagtgtgcggtaagagctagataaattatacacttaaaacacgtgagctttatggtatataaattttattgcagtaaagctattaaaaacaaatggcatacactatcataaagctaatattactatgtttattgaaaacctattatctatagacaacacatgactcagattacagagggaacaggtcttaaacatagaaactatgatttaagtgtatgctgatctctaaatgactgacattagctcctttttttgagatgtttcatgggagaaaatgtatagaaagctaagagaggtggaaagatggagacacaaaagaagaggacagggtcaggaggcccaagtgtacctaaatcacaagaatgagcctggtgattcaccctgcaatcctttgcctttagagaccctcttggataggaattaggaagcatctccagaagggaaggtgacaaagacaatgtaatacgatgtaggttttttagtgattctctttcaactattgtgtctagtatttggaaaacattagaaaaaagttttagctatacatcattattttatatgttgtatttgctgatacagagattcaaatcagttgggtgactggtgatcagtagatgctcaataaatatttgtccaatagaagaatgaaagaacaattatgctatccataaattacaatattaaatatccatgagctatataattcaagggcaatggggcattggctgtgagagaaaattgtggaagaaaagcagatttgggatagggttagaagataatgaggccagccttggacataatgaacttaagcagagctcgtcccattgacatagaaccatctggaatgcatctcaatatatggttctggattgaggatataaattaggaagttttcagcatagctgaagtcatggaagtctgtgacatataaatcaataatgaatcaatttattttaattgatatacaaaatatttccatgtaattaattctgtctataattctgtattttttggctctgatggtaaatctgaataagtctattaaaatcttcagacattatacattttctttgagaacaacagtggctgtaaacaaagctgcctttgttggcttataaagaacatttgctgttcccacaaattacttttaatgatgcaaaagtccctctgtgacagagacttgttctgtggttatgcatttccctttctaatttcactttgtttcctttctggggtatactccttttgagacacccagagtctgaaaaatgtgagtcaaaccacagattggctggtaggaaaaaaagaaaatagttcatttcccctcttattaaatgtttattcttgttatatataaactcacttgctcttgctatgtggcattacaatattagttttactggtagggcttttaaaatactatcaatcaaatggggtgatagatatattatggggaacagaaccctgatttggagttaaaagaacttttatttaaataacagcttttccatttaccaactttgtgatcttgggtaaactgtaaggtttctctgagattcagtttcttgatccatcaaagttaagtaaatttatgtttctagtaggtttttcatgataattacatgacattatatatataacatatataatatataatataaaatatatataatatataatatacatataatatatataatatataagatatatatattttatatatatatctccaatatctaaatagactggttgctgactttatcattagttgatggttgacagaattatatacatttattttaattatatcattatttttcatatctaataaaaacttaaatcagtggagactttattcaaatatacttcccataaaattcaatgtagcgaagtttttggagcattttttactttattttattttattattattatactttaagttttagggtacatgtgcacaatgtgcaggttagttacatacgtatacatgtgccatgctagtgtgctgcaccaattaactcttcatttagcattaggtatatctcctaatgctatccctcccccctccccccaccacacaacaggccccagagtgtgatgttccccttcctgtgtccatgtgttctcattgttcaattcccacctatgagtgagaacatgcggtgtttggttttttgtccttgcgatagtttactgagaatgatgacttccaatttcatccatgtccctacgaaggacatgaactcatcattttttatggctgcatagtattccatggtgtacatgggccacattttcttaatccagtctatcattgttggacatttgggttggttccaagtctttgctattgtgaatagtgcctcaataaacatacatgtccttgtctctttatagcagcatgatttatagtcccttgggtatatgcccagtaatgggatggctgggtcaaatggtatttctagttctagatccctaaggaatcgccacactgtcttccacaatggttgaaatggttgaactagtttacagtcccaccaacagtataaaagtgttcctatttctccacatcctctccagcacctgttttttcctgacattttaatgatcgccattctaactggtgtgagatggtatctcattgtggttttgatttgcatttctctcatggccagtgatgatgaacattttttcatgtgtctgttggctgcacaaatgtcttcttttgagaagtgtctgttcatatccttcatccactttttgatggggttgtttgtttttttcttgtaaatttgtttaagttctttgtagattctggatattagccctttgtcagatgagtagattgcaaaaattttctcccattctataggttgcctgttcactctgatggtagtttcttttgctgtgcagaagctctttagtttaattagatcccatttgtcaattttggcttttgttgccattacttttggtgttttaaacatgaagtccttgcccatgtgtatgtcctgaatattattgcctatgttttcttctagggtttttatggttttagctctaacatataagtctttaatccacctttaattaatttttgtataaggtgtaaggaagggatccagtttcagctttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtaccatgctgttttagttgctgtagccttgtagtatagtctgaagtcaggtagcgtgatgcttccagctttgttcttttggcttaggattgacttggcaatgtggtctcttttttggttccatatgaaccttaaagtagtttttttccaattctgtgaagaaagtcattggtagcttgatggggatggcattgaatctataaattaccttgggcagtatggccattttcatgatattgattcttcctacccatgagcatggaatgttcttccatttctttgtatccttttttatttcattgagcagtggtttgcagttctccttgaagaggtccttcacgtcccttgtaagttggattcctaggtattttattctctttgaagcaattgtgaatgggaattcactcaggatttggctctctgtttgtctgttattggtgtataagaatgcttgtgatttttgcacatcaattttgtatcctgagatttgctgaagttgcttatcagctgaaggagattttgggctgagacaatggggttttctagatatacaatcatgtcatctgcaaacagggacaacttgacttcctcttttcctaattgaataccatttatttccttctcctgcctaattgccctggccagaacttccaacactatgttgaataggagtggtgggagagggtatccctgtcttgtgccagttttcaaatggaaggcttccagtttttgcccattcagtatgatattggctgtgggtttgtcatagatagctcttattattttgagatacgtcccatcaatacctaatttattgagagtttttagcatgaagggttgttgaattttgtccaaggccttttctgcatctattgagataatcatgtagtttttgtctttggttctgtttatatgctggattacatttattgatttgcatatattgaaccagccttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcctggctttggtatcaggatgacgctggcctcataaaatgagttagggaggattccctctttttctattgattggaatagtttcagaaggaatggtaccagttcctccttgtgcctctggtagaattcggctgtgaatccatctggtcctggactctttggttggtaagctattgattattgccacaatttcagagcctcttattgatctattcagagattcagcctcttcctcgtttagtcttgggaggagggtgtatgtgtcgaggaatttatccatttcttctagattttctagtttatttgcgtaaggatgtttgtagtattctctgatggtagtttgtatttctgtgggatcggtggtgatatcccctttatcattttttatcgcatctatttgattcttctctcttttattctttattagtcttgctagcagtctatcaattttgttgatcctttcacaaaaccagctcctggattcattaattttttgaagggttttttgtgtctctatttccttcaggtctgctctgattttagttatttcctgccttctgctagcgtttgaatgtgtttgctcttgcttttctagttcttttaattgtaacgttagggtgtcagttttggatctttcctgctttctcttgtgggcatttagtgctataaatttccctctacacactgctttgaatgtgtcccagagattctggtatgttgtgtcttttttctcgttggtgtcaaagaatatctttatttctgccttcatttcgttatgtacccagtagtcattcaggaacaggttgttcagtttccatgtagttgagcagttttgagtgagtttcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatcctttttaactttctgtctcattgatctgtctaatgttgacagtggggtgttaaagtctcccatttttattgtgtgggagtctaagtctctttgtaggtcactcaggacttgctttatgaatctgggtgctcctgtattgggtgcctctatatttaggatagttagctcttcttgttgaattgatccctttaccattatgtaatgaccttctttgtctcttttgatctttgctggtttaaagtctgttttatcagaaactaggattgcaacccctgccttttttttgttttccatttgctcggtagattttcctccatccttttattttgagcctatgtgtgtctctgcacatgagatgggtttcctgaatacagcacactgatgggtcttgactctttatccaatttgccagtctatgtcttttaattggagcatttagtccatttacatttaaagttaatattgttatgtatgaatttgatcctgtcattaagatgttagctggttattttgctcattagttgatgcagtttcttcctagcctcgacggtctttacaatttggcatgatgttgcagtggctggtaccagttgatcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttaaaaattctctcctttaaaaatgttgaatattgccccccactctcttctggcttgtagagtttctgccgagaaatctgctgttagtctgatgggcttccctttgtgggtaacccgaccctttctctctggctgcccttaacattttttccttcatttcaacttcagtgaatctgacaattatgtgtcttggagttgctcttcttgaggagtatctttgtggcgttctctgtatttcctgtatctgaatattggcctgccttgctagatttgggaagttctcctggataatatcctgcagagtgttttccaacttggttccattctccccgtcactttcaggtacaccaatcagacgtagatttggtcttttcacgtagtcccatatttcttggaggctttgctcgtttctttttattttttctctaaacttcccttctcgcttcatttcattcatttcatcttccatcactgataccctttcttccagttgatcgcatcggctcctgaggcttctgcattcttcacgtagttctcgagccttggctttcacctccatcagctcctttaagcacttctgtgtattggttattctagttatacattcgtctaaatttttttcaaagtttttaacttctttgcctttggtttgaatttcctcctgtagctcggagtagtttgatcatctgaagccatcttctctcaacttatcaaagtcattctccatccagctttgttccattgctggtgaggaactgcgttcctttggaggaggagaggcactctgctttttagagtttccagttcttctgctctgttttttccccatctttgtggttttatctacttttggtctttgatgatggtgatgtacagatgggtttttggtgtggatgtcctttctgtttgttggttttccttctgacagacaggaccctcagctgcaggtctgttggagttttctagaggtccactccagaccctgtttgcctgggtaacagcagtggtggctgcagaacagcggattttcgtgaaccacgaatgctgctgtctgatcattcctctggaagttttgtctcagaggagtacccagccgtgtgaggtgtcagtctgcccctactggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctaggcaatggcaggcgcccctcccccagcctcgctgctgccttgcagtttgatctcagactgctgtgctagcaatcagtgagactccttgggtgtaggaccctctgagccaggtgcgggatataatctcctggtgtgccgttttttaagcccgtcagaaaagcacagtattagggtgggagtgacccgattttccaggtgccgtctgtcacccctttctttgactaggaaagggaattccctgaccccttgcgcttcccgagtgaggcaatgcctggccctgctttggctcgcgcatggtgcgctgcacccactgtcctgcacccactgtctggcactccctagtgagacgaacctggtacctcagatggaaatgcagaaatcacccgtcttctgcatgactcacgctgggagctgtagaccggagctgttcctatttggccatcttggctgccctcccgtatatggagcattttgaaatataatttttcctaccatattctttgtgtatttcctctaattttcccttcttttgatcttagatgcttttagaaagtctctctttgcttacttgaaactactctttcctaaagtaagaaagaacttaaattttcaaagaaaaaatgtatatataaggtaaatagatattattgttcatactcctatattattatttgaaatacacaaatttgttgttagggatgacaccaagccttctgaaccctcatcaggtcttctagaacaattgcctgctctactattaactatgttgcttgagatcaaatatttaaccctttggtgccatctctaaagtaatcagattagaaattagatctccagcagtttataagttgttgcacttttttgaggattttagatttaggactttcattttaatgatacaaaataaacaattaaaagcatactctgcattgttaggatgaccacttgagtatgacctctgatttcaatgtttatgatcatgtaggtgggtttacttcacttgctagaggctaatgaggaaagaaaaaaacagacacatataaatgaagcttccacagcaaggagggccaaatggtgctgtggctcactagaccaatgagggttttgcagaaacttaaaagaaaaatactgagagaattaagttaacacataatctatgggagtcatcgtgtcaaacttgtgcttactcttagcagttagtgctatagtattctattacattagtgccagttatttcagacttctctggctttttaattttgtttatatttcatttgtgctataaatggaatgtttgtattcctccaacgtttttgttgttgttgtgtgtttgtttgttttttgttaaaacctaatccctaatttgatggcattaggaggtgagggtctttgagaggcaattaggtcatggaataagtacccttatacaggaaatgtgagagctctctctctccttccaccatgtgaggacacaacaaaaagttggttgcctgtggatcatgacgcaggcccttaccagaccctgaatcttcgagtgtctcaatattggacttcctacagaccagaaccgtgagaaatacatttctgttgtttataagccactcagtctatgccattttgttattacaaccctaacagccaaggacatttataaataagttttaggcttcttggttgttaaagatctgtaaacatagagtgttttatgttttctctctatacaaatttaaatagaattttaatgagtacaattttatattttatattctagagaacgttttcctttgaaaagaggtctgtgcttcattgaagtttgagaaatattgaataaaatcttgatttattaatcagttctgtttttcattcccagcatttcattatccctggatgtttccctgctttcaacagtcgccaaggaagagagaacataggagaaagagagaacgaaagaattgatccttggctttgagtttcaaatggcacaggctctgacgcgacaaaagattaagcagaaaatattatcagggaaatgtttatctgcactttacccttatcctcagacatggtcaagattccacaggactaaattcaaaagtaggaagtaagggagcaatagaaatcccaaacagatttagagagtcaggtataggaagaatgtggcaaccatctccaagtaaaacccaggaagtaggcaatcctttgaagtccttctcatctagaacaggtaggaacagaaaaagtctcctgcctgaggttgcaggcagactggcctgcctcagtctctcagtttcccaaactcagcgtggcactagaaaaattcagtgatgccccaaagaggctctaaggataggtttattacagcccatcatgggatcaggagtagcagaatgcttcctgtggacgctgccttggagtaggggtcaggggtggctcagagtgctgccgaccagaagagttattgcaggcaggaatgaacaggacagggtggagacagtgcggagaaatgatggagacccagacatgacccacgtcatgcccacccatgtccatatagtcctgccaggtcctggcactacataagctgcatggagaagggaaaagaggaacatgctaatccagtggaatcaggcttctgatacctagtgcaatgatagagcaaaacagaaatgaggtttacttgcataaaaataacatcaaaacaaacaacaacaaatctatcctttctctgtatctatctatctatctatctatctatctatctatctatctatctatcatctatatcatctatctatctacctgaagttgtagtgggtgagaatcattaggactctaagatcatagtcaagtttaagataatgtctatccttaagaatggaacttgaaaggttagcatgtactaggaaaaatgcagcaacttgaggaacccaaagatcaatatttttaaggatctatcttcaggatctatctagctctaaccatttctgaaatttctgcagcgttggacttttgggtcttgatgttgataataccaagcaatcatcatgatcgagtcctactgtagaagcaaagtggagcccacttgtccactgatccccactttgtatgcggatggagtttgggccaaaaatcggaggtccagacctctgatgtcttccgagtaaagctaagcttttgtgccattttggagatagtaacatgcaaagatgggctgccagccacaataagatgaaaataacgagaaatagattttgtgtacaatcaagaagtctccaagtagagtgtcaatgctgtgattcttgatactgactgtctactggtaaatggttcctgggtcacttatatttgaatcagggccacctggctcttgggcagatgagttgtggcactaaacttcagaaagctgatccactgctcagtcatctgggaaaactgaggcagcctaccaggcccctaaatataatctgtagtgtatttgtcttaaattgattagaaaaacagaaaatggaaggttgtttccatactcatctggcttctaggattgatataactatttttcccttttttttttctccaatagccagggaggaaaaatccagtctcatcccactgatattaagatagccaaccttctagtgttttagagatcagattgtattcgctttctagtttttctaagattgtaaacccttagtagaaagtcttctacacctgatgtttttctatacacaatgtcaatacttagtacataaatataagatttttgatacatttgacaattcctattctgctgagtccaaatttccgggaatgtctgataatgtacagagaagctacaattacagcagggagatgaggcttgatgactacccaagggtacgagaagctttgcagaaggcaatggaacaatctagtttggggcaggactgccaagaaacaagttctttcaaaagtaacaaagaaaatctcatcaaattggatttcacacagacataaggctgtaattcagctgaggcaaacagcagggaaaatcattttcttgtccacttcaagtaacaaaatgattcccctcctgtcacttctgagttgattttgttcttttgccttcgaaagctgaatgaaatataaaggagaggttgtgcatctatctataagtttaaaaaaaaaaaaaaaaaaaaaaaaaggaaagctatactcagtgggaaaaatggaaagaaacagttgagttagtatctctgggacttaatctagaataaggattccaaaaatcacaatttggtctgctgttgggggagagattgttccccatgtcttccttaagcaccaaaaacaattacacagctccagcccatgtgcaagcattagcaactattctgggattgaatccaaatttgagcatgtgtaatagatgaggattttccacaatgtggaatatttgaacagataacatcagaactaacagttaatttattttttaagtaaagaagaaacaaaccataaaaacacaaggcgtttcttgctaaggttcagagacatattcagtgaaatacgcaaataccttaacaagaaataggtgacatttgacttaactctaatacaccataattagtttctttctccatcaaaaatcaaagttagtgtattttgatctaaagctagaattgagatttctctgctttttcttttggctggtcatatgaatcatgcttaaaatgggaaagccagagggtttgatgtggtccagacctatccgtagcctgtttcctatccctgattcagtcttatcagagctgtcccataatctgtacaactacccatacagcttcagaatatgataaagaaaatagacagaggttcttacatacagaaataaggcctcctcttttgtctctccctgcagagattctacaaatctttgagccaaggagattatcaaaatgactcacttttaaacaaacaaacaaacatagctcaccagtgttttttagaatgcaagaaaaaacacaaattggaaccaagaaaaatctgttaattgcttagattctttatttcccttttatgtttactgccactaattagtctggattatccaggggcctaaataaaatagtacgatctaaaaatgcatgtgttgcttttagtaagaatatcttcacttttttcttaaaagtgaagtaagactatcttcacttttcttaaacccattctattaaaaaagaataaaaaaataaaaaataaaacaaaaaactttactacattctcatctgggtcatgatcagtgctgaaatactaaccacaatagattctaactttgaaattttgacaatagttatcatactccgagtgtttactatgtacccaaataccaatactaaatattcactactcagtactttattataaccacatcacaatactttgaaacacagaatcattaaataccatcattttccgatgaaaaaactcaggtgtaggaaggttaaggaatttgctcaaagttatacagctagtaagttgcagagacatgacttgaacccaaatctcttcgactctaaattcagagctgttgaacttggcagcagtataaagtcactcctccactcaagaaacaccaatgattttatatcttatgccacaataaaaagtaaaaagactcaaaaataaaacaaaacttaagatttatagttatctggccatttcttgttagtttaatcttaattttcaccagtcatccacatgggtccccatgctaccaccccatgttccttaaagttcttacaagggcccagttcacttttgtcccttccctcacattgttttcctcacagtagtcttctgaaacgcatttcctgtctctccttcccataatcccactgttaccccatgtgcatattaaactcccaggccatgtctctataaccatacacagtttaatacagttgcaatccaagttagtgttcatcatttagctgctatagatagtagttggtgtcatgtagcttacatttgtatttcacctaaagtaaaccattatctattaaggtcagggactacaaatttataatttgattttttacctcaaaacacactatgaaactcatagagagctctaaataaattcctgttgtttaaatgaataaataagagttcattacaaatataacaaagtattttcacatgaatttcctagacacttcatattggtgtgagccacttcaaaacagtacaaaagggattaaatacaaatatatctttttaatacttattaaaatgttagacaattcagctttagtaggagtttaattataaaatgaaaccaagcaaagcctaaatacctaattcaaaagatttctgttctatagtgaaagacagatcaataatgataaattggatttttagcctttgggaataaatggggaaccaaaaagaaaagcaaaccttagtaaagtaattctggtctaccactagtgagtggacaaaattattttacaatcagtattacattctattggaatgaaaacaagatatattaaaaccttaacatgataaatagatatttgatattatttgtccaataataatccttaacagatataagcttttttagaacatctatgtaaccaaatgtttttgaaagaggaccaatccatttgctaaagccataaagtcatttagaactactgataataaacagtgacaaacagtgaaggcgatggtttcggaatacttcactttccttttcattcctttttccctcgcctttacaccagcaaagaaaaagtcatcataaagccaatgaagctaaagctctagggctacctgcttacacaggcttcgtcaaagtctatctatttataaatagcaagtaagatttttaaaattccttttcttgaagagtgccctccaaactgtttaagcttcaggtcccacaaaccttaattagtcgcatccttgacctgaagcatgcatgcccttggaatccaagaaacttaaaattccatttggcaaaatttgctgttgttgttgtggctttcttaggctgttggtttcctaattcgttcattcattcattcttcattcatccactcatttatccaaggaacagagactcatcttttgcaggcagagatcatcgttcttacggctttagagtgactacaacttcctgtctcttgttctatggcttctgccactaacaggtaaaggcatcacgctttcctctggatagcttttctgtactttatgccttccgtttttttctcatcttttgttgttctctctattgacctgtgcatttttgctacaagtagttacttcatcctatatctggtttatggttcccaagattggttttgttatatctgtagttattccttgttgggcaaaactttcagagtagactaccagcagattatttgcaggccataataggctgctcactataacatgccctgccctggtcaaacaaatggaagaaaccaacaatcgatgccttccatgaatccacttttactttctttctttttcttcctcacagcattattatttcaccttcataaccagaaaaatataattctatccagcattataattagtcaaatatttcatgttttatttattttttctctatccccacagggcttagtgttaattgaaataatatcattataattaattaaaatacaaatacagctaccatcatcttactatgtgtttggaacacaactattgttttcatgtgtcacttcccctaattctctccaaaccccttgaggtagttgttactccattaaccatttcacaaacggggaaagtgagactcagagagcttaggcaggttgctcagttaataagcatggttgctaggatttaatctaggaggtctaattctagagcagcaactttcacttgtgaacactggaatcacctgaggagtcttaaaaatccaggtcccatccccagagtttctgatggatagaagatgtagcctggccggggttgccgggggggggggggggggggcgctgtttttcatcttcctcggtgattctcctatgtcccaggtctacagaccaagttatttaccattaggtaataaagagtgaatggacaattgaatgcattaatgcatgacctccccattctctattttttaatagataggttctgagagttccatttaaataaaaacatcaataacatctaattggcctctcagaaaataatgaaacccattttgtcaaaattgatttaccctgaccaaacctgttgccaaagagttaatgctctttcccggagagaggcagtgaacagattccgtaaatgaccagcttagtctaactccctttttcacgtggacaggggccgtgttggggaagctgcagagcgcatcaaactgaagctgtttgaatgggcccctaggtccatttctttgttttatgtcctccaattccctcagcctattatccttaatgtgtcatccctacttgttttgcctctactggggagtgggagcctcagcgctacaggcaattagcactcagagtaggcaatgggagcttcattttctaccctgcagccaaattttttgttagtcacagtcaaaccaaagatacagaataaagaacctagacaaaactataaatacttaccaagcaccaatttgttatgtgttagtcactgaactgacattataaagtgactaagaaattcaaggagttaataacctggggtgggtgagaggaggataggcatgtggaacaagatgagttgtgaatatttaacttgtgtgtgtgtgtttgtgtgtctatgcgtgattcagtctgatcatgctgaggtttgtgaaccaccaccttatcaactagttctacctactccttatagaactgaggggctaactaaacaggcatccagtcagagcatctgtgacaattagagtccaatccacaaaccctgcagcaaacggtccaggaagccaaactgcaaactctgcagcaatcagcctagagcaggtaggtcttggccaataacaaccagcgtccctgacttttgccttgcttccaactcaggatcaaccaaagaaaattaattatgctccccaaagcagtcatagaagatgctccacttctaggtaacctgccctcagcttccctgtgccaacaacctccaatcagggcactcctgaagccttcccattttgcattataaaactttcccattcccgtgtctgcctttgagtctttgccaaaatgcaagttgcaagagacagtggctgactcccttgctgtagcaagttctgaataaataacctctgtttcttctcatttaaattgcctttgtttatttttacagtgcaagtgggtggtggggggtggtggtgcggatgctgttttgaaattttaagctcaccctctccaagcaggtgaaccttctcatatgtgtttccctgaaatctccttgcctcccccttaagatgtgtgtaggaagggggaaggcagaatgacagaaagagggaatggcacctgcatcaaatccagacagatcaacccaaggagacagaggcttgacttcttgccagtgttacagtggcatttgaataagaacctaagaccttagcctcaacctctaaagaggaatgaaatcgtgaattcagtcaccattatgtttgaaatgacagaaaaatcacgccatccattgagtttccttagatatgatgaggtttttgaaacatcatatgcaatgaacattcaagcaggaatcaagttcagttagggagaaatacaattatattttgtcatggttgaatactcagtggtgctaatttgggttgcctactttggaagtttagagaggacgatatgcactgagaaagggcggagctcagggcccaaatggtggaagaggtagcattttgagctgaccaggaaagatgagaattttgagaagtggaactttagcttcctccaggctccagagacattggtgcaaatgtcttattgaaattaagcacataagtttaatgtaatacagaagtcagtgcagtggctatacccctgtccctttgctggttgtcagctcagtgggtgggtggatgctgtattcactcaaatctagaaagttgtgagtacactgatgtctgtgggttgggtcacaccaacccacagacatcagtgtactcacaactttctacatttgttgctgaggttctttttaatttctacaattattcaacatgtgtctgaatgctaaaaataactagcgtaaccaaacatagagagaaacattttcttgttaaggctgagtttttaaacaaacaaaaataatgcctttccccactgcctaatgtacatttttaaatcatagaaattgggttctttgttaaattcactgtccctctttctctccaacattgatattagtaagacagttttttttttctcccttctagaagaatgtggcagaatgagcacaaagtaattagcaggtttagttagaagttagaaactgagaggcaaatgaaattaaagttggggtaaattaattagtaaaaggtgctagagttgtgtgtgctccttaactaagtgttgtctttcaatgtgtcagcactgacaacactttgtgaggtttagaaacacagaagaggaaaggctgacaaccagggagccagaacgggaaggtgttgagcagggtgtgagactcctgggaagggaagaataggaaccatccctgggattgttctagccttcccaatcctttcctctgaggttcagcagtgcaagggagaccatcaggtcaacgtgggggagggtacttggcccatgtttctagacatcgggaaatctgtgctgaggagccttggaggccagtgtccattcataagagcctaaagtccttacgaagaaacaaaaacaaaaacaaacaaaagctgggcctgtatattagttttctagggctgccatagcaaatatcacagactagggggcttaaacaacagagaaatctgttttctcagttctggaagctgtaagtccaagattaaggtgccagtagagtgttttcttctgaggtctgtcttctccccgtgtcttcacatggtcttccctccctgtttttctgtgtctgtattagtctgttctcacactgctataaagaaatactccagactgggtaatttataaaggaaagaggtttatttgactcacagttctgcatggctggggaagcttcaggcaacttataatcatggtggaaggtgaaggagaaacaaatgcacatcttacgtggtgacaggtgagagtgagtgtttgtcagctcaggaaaatctaccatttataaaaccatcagctctcatgagagttcactcactatcacaaaaacagaatgagggaaaccgccctcacaatccaatcgcttcccaccagttctctccctaaatacctggggattaaaattcaagatgagatttgggtggggacacaaagcctaaccatatcagtcctaatctcttcttcctgtgaaaacaccggtcttactaaattaaggcccacctcaatgacttcaattaatcttacatacaagtttgaagagtccatctccaaatacagtcacattttgaggcactaggggttagaatttcaacatgtaaattctggggaggcacaattcagcccataacagcttgctgaagaattctgtagaaaaggaagctgagtgtgtgacagtttgccccactgtgtgctttaaaatgaactagcttctcgaagaatacataagccatcttattctggaatggcataagtgctttcttgtccccaattctccagcaaaaccggctgggcaaggcaggagacattacaactaccaaagctattccaatccatacacaaccccaggtgactcctacatgaaatcagccggccctttgccccactgctgtccggcccccttatgcagaaaaaggagtgcaaaggcaaagggagaaggcatataggagcttttacacttagaaattgcagagtagttatttttcatatgtattaaatcctggttttcttggttgatgggccattatgattagaaattttacttgatggtatgaaagcatcttgctgttttctttgtttaattatttgatggtgagtaatcacatattcaagcctaagtcactcgttacatattttaataagaatcttttgtcttagaaagtaaaagtgctgactgcatgccttctcatttggaaggcagcatcttgtaatgaagtcagcaaagacagagaacatgttttattaaaatactacttctaattccatctgtgtgaccttgagcaagttacttaacctgtcggaactacatatttctcattggtaaaatacaatcatgtaaaggagaagtaagtgagatattgcatacaaaacaacaagcatattgcccaaaacataaccttttgcttatctaggttaattatgcaggtagattcccatgtttccagtacgatgtcatgaaaataaaaggaccccatgcaaggatcccaaaagcctgattgtaagtccaatttgatattttgttcaatcacttggcctctgtcagcttcagaattttgaatgttaaattggaggcaatggccatcttttgaacttgacacaatttatcaagaggatgaagtatgtaaaagtatcaaaaatgagtcactggcaggctctgataatgagttaggagcatctccttcatcataaagagttcatttttggggacaaagtattaactctttgcaaattactggaatgattaggtaaaatttactaaaaatttctcttgtaggaatcatttctcagccaaacaatgtagcctaaagaaagtggggctaattttgcagatcaagttttttttttttttaagtgcgtacacattttgaaaatcaatattttcccccaggtactcagggttaaattgctcttgtaggaatcatttctcaaccaaaacaatgtagcctaaagaaagtggggctaatttttgcagatcaagcttttctttttaagtgcgtatacgttttgaaaatcagtattttcccccagttattcagggttaaattgttcttgtaggaatcatttctcaaccaaaacaatgtagcctaaagaaagtggggttaatttttgcagatcaagtttttttttttttttttttaagtgcgtatacattttgaaaatcaatattttcccccagttattcagggttatctgataattcttagcccagtggaaatggaaatggtacctgcactccacatttcctaagttctgaatttgtttgatatatgttgttccacagtcattgtttccaggtcctacccctgcatccaacaataaacctggtattcaaacaaagcagatgtcgagaatgaggatgaggaagtgaggtgagaagggcacacatgtgaagaggacatagggcataccctctagtactttcaactttaagttgattctaggacattaggatgacaactgagtctggtaccttgctccagttctagtttctacctgaaggactctagagatggggaagtttctgtcaaagagtttcttctctggacattttttcccctttaagctactggttaaaaattactgttgactggctgggcacggtggctcatgcctgtaatcccagcactttgggaggccaaggcgggcagatcacaaggtcaggagatcaagaccatcctggctaacatggtgaaaccccatctctaccaaaaaaaaatacaaaaaattaaccggacttggtggcgggcgcctgtagtcccagctacttgggaggctgaggcaggagaatggcgtgaacctggaaggcggagtttgcagtgagccaagatcgtgccactgcactccagcctgaacgacagagcaagttaaaaaaaaaaaattactgttgactttgacttttgggtaaaatatgtattcttttatttatctcatttatatttattgaatgcctgtaatgtgacagggactgttctaggaacctgggaaacatttctgagcaaaaaacagaaacatccctgtcctcacagagcttgtgatttcaaaattatctttttctgagttaaaagtcaaccatttgtttttaaagacatggtggagcatggcaattttcaaactttttgatttcagagcctctttacgctcttaaaaactgttaaagactgtaaagaacttttgttgataccagttatatctatcactatttactatattaaatgttaaaacagaaatttaaaacaataaacaattttaatttattaaaataatgatataaaaccattacatgccaaaaataactgctacagaataaatatttgtatgcccctaaaattcacacgttgaagccctaacccccaatgtgatgatacttggaggttattgggttgagataaggtcatgtgggtggggccctcgcaatgggattattgtccttaaaggaagaggaagagataccagagtactctctctccactttcatgtaccaaagaaaggccgtgtgaatgtatagcaagcatgtggctgtctccgagccaagaagatggccaacaccagaacataaccacgctggcaccctgtgctcagacttccagcttccagaactgtgagaaaataaatgtccgttgcttaggtcacccagtctgtagtattttgttacagtagcccaagctaagacaataacatattttgtaaaaaaacaaaaaaacaacaaaaaaaaaacaacaaaaaaaacctatattttctttaaaaatcatgagaaggacactgttttacatttttaaaaatatatatattttttgttctggtttaacagaatagttgtattttcatggctgctcctttattcaacttgtggtatcaacgtcatacagtgtttggaaagtcccactatacatttatgagagaatgagaaagaaaaaggcaaatcatgtattaatattattatgaaaatagttttgtcttcatggatcccctgatggtgtctcagagatccctgggggtccctggactacgttttgagaactgatggtatagtgggaaaagtgcctctctgctaaactgagttttgatctgtgatcttgagaaattttttcatctctctcaacctctgcttcttccatctgaaaatgagtcgtttgtcttacaaaatgggcagaatctttcccatctgtgaccttccttgctctgtctgccctctttccttcttgagttggccatttagtattttaatggaatggacttagttttctttttcttcttcttttgctctccacattatccccatattcctggatctggcactaatcagggctagcataaaagaaggggggtctttgtgatatttgaagcttaaaaaggtacagactcctagcaaaaaagtccagggctagtctatgcagcctcaccttgacagtgcagctgacatagtattgacaacagatacctgaccccagaatggacaggtaagggcagctttctttttatttatttttcctctccctcaagagcatgatctcatctacatgatctcaactccattcagctacatcctgaaaaactgtgatgactgacaaaaggaaccgaagtgggactttgatatgggcaaataagaagcaaagtagtttagaaatatccaagacaaatagaattccccggtgaagtcagccccacttggagacagtggcttcataagtcctgaatgatgcctctgcccctaccttttgctccagagaagcctccccagtctgaactctttgctattgagaagccagcgtgactagatgaataagcagtggttctcggacttgaatgtgcatcagaatcagcaggagggctttttttattttattttgtcttattttattttattttattttattttattttattttattttattgtgagacagagtcttgccctgtcacctaggctggagtgcaatggtgccatctcagctcacagcaacctccgcctcagggttcaaatgattctcctgcctcagcctcctgagtagcagggattagaggtgcccgccaccatgcccagttaatttttgtatttttagtagagacggggtttcaccatgttggccaggctggtcttgaactcctgacctcgtgatctgcccacctcggccttccaaagtgttgggattccaggtgtgagccaacgcgcctggcccatcagggctttattaacacagatttcagggcccatttccacagcttctaattcatcaggtctggggtagagttagagcaattgcatttccaacaagttctcaggtgaccgcacgttgggaaccagtgcaacacagtaaattatagatgatttgagctaaaggatggcaatgagacttttggactctgaatgtctctgtaatctgtttacaaaacaaccatactaccaggcctccaacataatagtttgttccattctaacctcttatgattaagggtgaagtaaaaagggtcacatcactcactatatttttagagtagttattctaagaggagattctataaggagcacactataacctttttataaagcttattttctattttatgttctcctgcttggggtgggagggacttctagagggatggcaggggttactatatggttaaagccttaatttgaacaatttctttttagtcgttacagtgcagatgtaaagtattagcagtgaacatggggcttgagttcatgattgagacagggtataaataccctgcaattatcttaggcagactgagcctgtaatctttccagtctgggtttagcttcatttttccatgaccttttaccaagtataaacacaacgtcaaagattctaatggttgaaataaatgcagtctattatgttatacaaattaagatcagtgtttggaagtccagggctgaaatcagaagattttgtggagaccattacggccatctggtaagttctccctggccttatagggccaagagatgagaagataataaatcagttaagcacttggcattgtgtttgtttcacatacagtatctcatccaatcctggtgatttcttttggtagtgagagcgactacaaatagaatccctattcaacatacaggaaaagagaggctctgagaaatcaaactatttgtttcaaggcagcccaactcaaacagaactcagatttgagccattgtgtatctgactctaactcccacagctctcaggaaacacaaaattcaactttttgacaatgaatatttatcaatatcaactttgttgagagaagagaaatagcaaaaaaaaaaaaaaagaaaagaaaaaaggtttttgtctcttggtatttccaatttagtgaagagaaataagagtgtttctggaagggatcaagttcaccttctcattttactcatgagaaaaccaaggtccagagaaatcaaatggtttctttgtagacaaaaagcaagtagcaagggtgtcttgatacctttaaatctacagagaaatgctgaacaattctttctaatgaaaaatttgcttatttaaagaattctttttgctttcttgccaaagcaaaccttccaggtagaaagaagactggtatctaggcttttacatgggctctctgtcaaggtcaggcatgaatagcaagtcctaaattctcacctgaccttgaaggtcctgaaatgctctttctgttcctgcaactggccaagttgttttcacctctggacctttgcatttgctattctctctacctgggatattcttcatttggattttcatgaggccaagtcttactcatcactcaggtctcaactcaagaagatcccctctaagaggtcttccctcttggctgtcctaagagcccaggatgtcagttctcttacagggcaattgcttctgcatcccattaccagagggagtgtgttctctgggattaactggctttcctcattttactgtctcacttccccttctctcaccatacttactgagatcaactccctaatacatcacttgcctttaattccttcttttggggtttgcttttgtgacaacccaaacacagaaacgaaatcttattcaacctgtctctcatgactctgattattttttatagcacttattactactgtctgaaattattgtatttattaacttgtttatcatctgcacttccatcttacctgactctccgcactctccccaacctcctccaccccatcagacgcctaatagaatacaaacactgtagtggcatgactttgcctgtcctgttcactgtggtatcccaaaaacttagaacctagcccataataggtgcttaacatatgtttattgaagaaatgaaagaaacaaatgaaactctccaatgtgttaatataaaggaatcttggctagtaaatcgtgattttgaactactaaatcaaaggctttctctgtttgcttcagtcccatttagattccattgttctttccatttttggagggaatcaatccttaatcaatcactttttgctaagcatgctgtccctgcacaatcaaaagttaacaaagatatataaaaatcagtccaggctttggagccaaaaagttcattatctgcctcaatcaatatttataacaggtatactgaagacatgctaaagcagaagtctctgttcctttgctttccttccatcacatttgccttgcataatcatctatgtttattaaaagggttcctggtctgttcctgttaaacattgaccttcaagtgcttgacttaataagctggagaattacaataaatcagacagccttgttcaatcattgatattacaaagaattgcaaggagaaaccagaacagcttgaaaacacaataaagtacaacagctttcatagagagtaaaagggaaagtcaagggaagaaagtctgttctcagagatgctctcatggaattaagagagcagaatcccatggcattcaagactgttttccccctgattaaaacgttttgtcaaagcaaaaatcaaatgagtacttgcttatgaagcatgcgatgtttcagaacatgacacaggaatcataagtgttcaaataaataaaccccattcaggaaaaagagcatttgtcacagatttttccctatatgaagccaatataggagactataaggattgagggtaaggatgctattccctgaaatggtttgcctccataagagattataaggcaccaaaagtgcagatgtctctattctatttaccaactccttctcataaacccggtgcctagaaaagggcttgccacatagtaggtgatcaatgcatacctcatttagagaaagaatacagagctatttgtactttcttgggagcaaaagattctcatttgcaacatgtttaaactagcatagcccatctttggcttacgttattatcagtaaggagcactatgattatgtgctatttcttacatatcttattgcatccccagaaacagataatattccatttagataagtcttgtgttaagaactgaattctgtgtgataagtaaaagattagtatttggagccaggcgcttaccattctaagctttcttttcctgatatttaaaatggggctattaatgctaatcactttataggcttgacggacagattaaataaggttgttgatatggtttggctgtgacactacccatatctcaccttgaattgtaataattcccaggtgtcaagggcagggtcaggtggagataactgaatcacggcggcggttcccccatactgttctcgtggtagtgaataagtctcatgagatctcatggttttataaatgggagttcccttgcacaagctctcttgcctaccatcatgtaggatgtcactttgctcctcctttgccttccaccacgattgtgaggcctacctagccacgtagaactgtgagtcaattaaacctctttcctttataaatttcccagtctccggtatgtcttcattagcagtgtgaaaacagacagcatctatgtagcactcaggacaaagtagacactcaatacacattggttaacctcacatttcacgggtgagaaaactttggttcagaaggattggatgaccttctccaggatcaccccactgggaattagtgaagacagaatttcagaaaacaaaacttcagatctctctgaccacagaacccatgctcttcatccaagcatcattgtgtccacggcaaggagtgtaattcaggtgcaaactttgcatattttcatttcagtttacctggcttacatatagtagctgttggcatcaaaagtacttgcttttaaaatgatgaactggctgctgttgactttgggaatgggagtgaatttacgaaagttctcaaccttggggaatttttctcactttataatatagatagacagaaaacttgggtcattttaaatgcaagatatttaggagtggattcgctaagtttgctatttaaaatgtgtctgataaaagttgatgttcttgggataaatgtgtcataagttgagataatgtaaccagtgttgaagcagaaatgttaaaaaaaaaaacagtgtgaatgtaaatgatgttttgtatatcactgactcaaagacttcttacataccatcctcctacctatacttcatgctgtattagctgaactataaagtggcaagtggcaatgtgattttcattttctcccggcaaaacgttttgacctaggagggagccttgaatgaccttggccttccattccctgattttttactgttccttttttttttaatccttctatatcctccctcatatccctaagccatactgaatgtcttgcagttttgttagtcttgatgctacattagaatcacctcgcaaaattgtaaaagttgcagatacctaggcatcacttgcagagagtcttaatcagttgcttgaggtatcatttctaaagatttcctaaatgattctaatgcatagctgtgtttgagaatcaccgcaatttttctgcctctgaaccattacagaagttaaaatttctttctttctctttatcctctgtgtaattcctagccattcttcaaaatgcaattcagaaggcactagttccaagaaacgtcatcattgcataatgttggtctgcctttgtatttaaaaatttctctgtgcttcatgctaatccacaatagatttcactaaactaaattccttgaacatgaagacaagccatggaaattgtttgtttgtattcatagtgcctagaattgtccatgtaggagctatttaaaaatatgttaaaaatgaatgagtggttgagaaaggaattcttaaaaagaggttaataactctgggtacttgtcctggctgtgctgtttacaaatttgccctataactctgatgctatgttgactgcaattagatttaaaatactatagtatataaagttaaacatatgcatatattatgactcagcaatttcccacttagacatccaaagaaatgtatagataatcattgagttataatggggttacagtccaatatatccatcataattcaaaaacactgtaaattaaaaattcacttaatatccctctaaaccctttttaaacttacaaaatcataagtcaagccattgtaagtccagatgctccttgacttatgctgggattataacccccaaaaggccataatctagttgaaaaatcctaaattgaaccattttaggtcagggaacgtatttctgtatatatatgctccccgaaggtatgtagtagattgttcatagtggcacatttttaataaccaaaaagcaaaagcaatcatcaatgtccatcagcagcaaaacggataaaatatttgtggcatagacacacataggataccatgtagcaacaagaatcctataaacgcatgcaatgatgtagatgaataatagataactttgaacatatggagccaatcgcaaaaaagtacactattgtatgttatacatttacatatagaactaaaaccaaaaaagcaatctcttctttagaagtcagggcagtcgggtggatcacgaggtcaggaaatcgagaccatcctggctaacacggtgaaaccccgtctctactaaaaatacaaaaaaattagctgggcatgctggcgggcacctgcagtcccagctactcaggagattgaggcaggagaacggagtgaacccgggaggcggagcttgcagtgagccgagattgcaccactgcactccagcctgggcgacagaaggagactcagtctcaaaacaaaaacaaaaacaaaaacaaaaataaaaaccggaagagggcaatgattggaaggaagcacaagggtggattctggggtgctggttgtgcttttgatctggtcattgattaccctgttgtgtccagtttattagaaatacatcaagcagtacactttggatatgtatacttttctgtatatacattgtacttccatgaaaagttaatactttggtataaacaatatgatagatttgtatttataaagtgactttgatctaaaccttagaaacacttggttaatatctgaaagaatttaccttccaggtatggcttctcaaatggggccattgtattggatggcagtgttaatcagtgttaattttttcagtcagagagaggtaccgtggtaatgaggagggcgtgtgatggagattgtgtgtgaaagatggagatttattgtgctgtcctgacagatgtttactaagttttaaaatatttcaaaataaataatttaaaatgtgaaaaaaagagaattttgttgcccttgtttcagaatcttccatgcaaaatgtttatcaagcctcgtaaaagcaccaacaacaggaatttcaccagccatataagaacagcctgtttctgtttaacttgttcttctatcacttactattaaaagttttgtccctttgacagaatcagatttgccacttgtatttgtaatacaccaccctataaatcattaaaggcctccaatgttcacccaaatcctcatacttgtggaatgaatatgccggattaggagaagccatttatcctcttggatactggatccagattattctcatctgtagagcattgggttgtatttgatgacattctcagtttttaactttgatctagattattattaaaagtgcctcatttctctctcagaggtgtcttggttttgaaaataattatatggttttcctgcttccaaggaatcttccagatttagctttctagacatctatggttttaaagatgtgaactagattcagcagaccactgaagtgcggggtaggcatctccctgtgtgtttgtccttgtgtagcagatgcagatttataacatgttagaataagaaatttttgcggccaggcacggtggctcacgcctgtaatcctagcactttgggacgctaaggcaggcagattacctgagctcaggagttcgagaccagcctgggcaacatggtgaaatgtcgtctctactaaacgacaaaaaaaaaaaaaaaaaaaaaattagccaggtgcctgtaatcccagctacttgggacgctgaggcaggagaattgcttgaacccaggaggcagaagttgcagtcagctgagatggtgccactgcaccccagcctgggcaacagagtgaggctccatctcagaaaaaaaaaaaaaatgttttgcaaatgtcaaaaattcaaaaataatcccttttagggaagggaattcattaattgcctcattgctaatgattattacacatgctaagatttcccttcttgagtgatgctgaaagtaggacagaaggatcacgtcattaagacattcctgttttcaatgtctctgggtttgtcctatttacaatcaaaagttgcctacttcctcacatacacaatgttaatgctttattttcaaaacctcctgggtttaacatgtgtaattattaatttattcaacaaatgatggagagagagagtacattatctgctatgtgccaagaacttaaaagggtcagggcagattattgaggcaaccggaaaatgaggatgattccttcagtccttctgcatcccatatttccatggagtcctgtgggtctttatggcaactcttgttttcttaaactcttattccctagtccacatcttgtgctaccttttcttgtcttctattctgcccaggctccaaggttaggcaattcaactatcatctccctgaattaatcaaccgtcttcatcttccatcatcctaatctatactgctcacttagtaaatttagtaaatgccacttagtaaatgccattcctatttgctaaatactgacagttaagacaattttaaaaatattactacaatttcttctgattctgccataatttcttgttatgtgatctcagtgaaactcatgagattttttctcatttcttttattaagttgtattttgttttctaatttttactctcaagccaccaactttcaaagaaggaaacatacacactagaaagcccagacgttttgcttcatggagtagactgaggccattagtttccttttctaactcaaagtttctctgtgtcatcattcacatctttcgacttcccttctgccctggaggaaagaatgtctttcttctttccccagttgcttggacactagtttccttctgtacaattctttcttatctaaccccccaaacccataaaatctaacttgagttctcaaaatgagactaaatttgttctgaggtctccccagaccacccacaggtgacctttgaacaacatgggtttgaatgacccaggtccaattatttgtggattttttccacctctgccacccctgagatagtaagaccaacccctcctcttcctccttcttagtctactcaatatgaagatgacgaagatgaagacttatatgatgatccacttccatttaaaaaatagtaaacatattttctccttcttttaatctttttaataacatttcctttctcttgtttacttagttgtaagaataccacatacaatacacatagcatacaaaatacatgttgatttactatgttattggtaaagcttctggccaaaagtatgtcattactagttacgttttggaggaatcaaacgttatacatgaattttcaactgcaaacgggggtcagcatccctaacctctgtaagtgtcaactgtatttccaaagccaataactcttctaagtttgcttttacatcactaaggggatttgaaaattggccatcctgttcttgaaattctttcttctcttggcttcttctcatagatttttccttctctgctcttccccaagattcctgttccatttcctctactcttgttttctgaaaatatacatcccccaagcttgtgtcctctgcccactattctatcaatataatcccattcactgttctcatgaatctttaactgtcttttaccttagaaagccatattgtgagtcaacacagagctccatgatgcatagccttcggccataaacacagctaggaaatgagggcagaaactaccatgatggagtggtacttcttgacctaggcacctggcccatgctgatggcaccaggagacaaggctgcaaggaaaggtcaactttacaaatggcatcagtagaactagaacatgacaatctagctacaaaattctcacatacggattcaggtaaactccgagatcttttacaatgaaccattcaaagactgggatcacttaagacagtctgcagaggtctcacaaaatggacattttagaaaagatggtcaggttcaccagactgcctcttataaagtatatcattgctgctctctgctggtcaaaagcattattctcttcaattaagatgagcagaggtgtagaatgggtcaaagagggaaagcagtgctttcaaaatgatatggactggtgctaggtaagacttattaaatgacttcatagactgcaatatacattcttatgcagaaacactgattttagtgagggtctattggacccctaaagtaaagatgtgcaaagcatccccatttttgtagaccttttactcatagaaaatatgggctctatcagatatttcttcaaccactaaactagtcaccactttttagtgtagaacttactgtaaggcatcatgtttgtatttttggcaggaaaattggcaagtcctactgaggattattaacttgatatactgcaaaatcctaaaatgttatcttaatcctaaaataaagattaaatctacatatacgtacaatctattctactgaaaacttatttttaagagtgtatgggtagtagtttttgattattcagaatatttgcatacaaagtgtccttcatgagcagcacaaaggggcaaatcttgggctcgaaagcctaacacacaggtttacccaggctctgccacttactggctttatttccttgggtcagctcttgaatatccttgagctccacgtccctattttgaaatgcgggaaatcataatacccacctcctattgttattacaaatattaattgaaatattccctatgaaatgcttaacagtgctccctgcaagttaattggcagtcagtcataactgttactattcatgtaaacagcttaagtagtagtatttattacatcttccaaaacaaaaatattttaccacgggttttaaatatactatgtagatatctggagaaagttgtctttagagctgttcttagctctgacactggctgtgtaatttaaagtaatgtcttaaattttctgagccttgaaatgtttccggatgcttgccgtgccctaaggtcctaacatgtctctatgttttaattttatttaccactgttcagtggcctatggtacaaagggttttgttttctgacctactgttccccacctaatgacttgcctgaagaacaaattaccactggaggaagcgagtaatctttctggagaattagcaaaggataatttttagaaggaacaatggaagcagaaaagtacacacgcacaatcttgcctttctcttttcggatattaccacactaaaatatgatctgactcttctgtgtttattagttcagcaaataggcattgggttttcactgggtttgtaaactagaagttacagtgtgctgaatcttgagaaaactgattgctagaggtagaacaacaagaatgttccagatgtttcctgtcctttcctccattcctccattaggtacctctcaaagcctaagttgatgataattctcttgggatgcaggtttagacatgtctatattaagagacatggcagggagtcctcctccagtccaagcaaactcatcaagttccatactactgctggagggttccagcaatataaattctacagacaaagcagtgtcagtcagaccccagagttttgatacgacttagatataagggttgagtcaggacaaactattaatttctgtcttctgtagtcactgtcccttttccttgagaatcttcctcatttatttgtgacttcctcctttctccaacaagacctctcgtacctttttatgatgctatacaagctcagctgcctccatgctctgcccaggcctgccttccttaactgcacactgtgggcccttctcataaccaaactctgggttccattcctttgatcaaccctactgaattcatgaacacatcaggctaatatttcccttttctgtcctgtcgtcttggcaaaatatttgaacaagagggattagggttgaacatggtaaaagatcaattctcatggttagatttcaaggccagaaagaccctgaaaacctttcagaattgtggtacccgacgacaccaccagtgcactggaagagctccctctatcacacagagcaaatgacagaagaagcaaccctttcaatcaaaagacagcagcagtgaatagcatttccacagatgaagaagatgtggaacagaacttaaatcccttccaatggtttcctcgatgctcaagcttttcttatcagggaaggcagggtaaattcttgttctcccccatactccatatttttcttttttcatttctttgtaatacaatatttgatacatttgaagatgccatatctttagttaaaaaaagaggctttgtttgattctaatatttatcaaattagtaaactcttttagcatcttatcatctagtcaaaatgcctttagagtgatgtcttagatctgagtctgtgttaaagtaatgttttaactttttggagcctctgttcatctgctcaacaggtataacaattcctgtttcaggacttactacaataaaaacatggtaaaatacagttatgatgagattactagcattttaatgaaaaaagcagtggtaaacttagaaataggaaatttttccatagtaataaaaactctagatgttattatgaacacgtttagaaataatagttaataaaacatgtatttttctaaaatgaaggctttttcccttacacaggcttttttgtttttttttttttgatggagtcttgctctattacccaggctagactgcaatggtatgacctcagctcactgcaacctctgcctcctaggttcaagtgattctccttcctcagcctcccgagtagctgggactacaggcacatgccatcacactcggctaatttttgtatttttagtagagacagggtttcaccatgttggccaggttagtctcgaactcgtgacctcaagtgatctgcccgactcggcctcccaaagtgcatatgctgagtcattgccatctacatgtcttcgctttgctggtgttgtttctgccacctggaattcttttttctatttccaattccttctcaactctgtgccctaaggatcccactcaaatagtgtaaatattattaattcctcaaaactcagttctgtcagattccccatcttatttttcttattgtacttataccttgcttgtcaaactttatattcttatatattttcaaacacaaatatgctttttcatgctgtggtctttctgtctacagagcatgccatcattcttgttccttctacaaatcacttactaatcctaaaagccaaattctgaagactttctcaataagttcttgcacaaaggtaaggcacttctttctttttcttcttcttttttttggttgttctctcaccattgttttacatccctgtggttggcagaattatggcctcatgatgtccaagaactagtccccaagaactatgaagatgttaacttacatactaaaagggactttgcgtatgtgattaccttaaggatcttgaaatggggagattatactagataatcctggtaggcagaatgtattcctaaaggttgtaaactgaaagagagaggtgggaggctgagtgtcagggcaatgcagtatgagaagactcggccgccatggctggctttgaagatggaaaggagtcatgaggcaggagtgcgggcagcctggagaggatgggaaaggcaagacggattctcccctagagtctccagaaagaaacacgggcctgccaagaacttcattttaccctagtgaaagtcattcagacttctgacctccaaaacgataaggtaataaatgtgtgttgtttccaaccattaagtctatggtaattgattccagtagccataggaagccaatacaatcactccactctaacactaggtatttttttaacttgggtttgcatgttgctttatgttagatttctttaaaaagaatcccacatcacactaagactcttatttatttatgagttttctctggagcaaaaatcaggaaagtgagacctgcagcctgagctgccataggtgcattactcgtttcaattatttgctttgtcctcggaagacaagaaaacgaaaaagagagacagataagacaaaaatagaaacgtaaacaaaagtaagcacctctttcagttttattatatcagtcagaagtacttcaggtaaaatgggaagaatgccaacatgtttttgagcatgtactaggtaaaatggtcattagagaaactgtgaatttggatacatggcccagatgccccttcaatgatggactttgcccagtttgctcagagtactgtcagcagaacaccccctgtggccagctcctcagggatggcttcagctgtagacgattatcttgctgtgatcacacccttcccagcccacatccaaagagacatgactttccatctcgactcaactcaggacaaccctaaaggaacgttctagccttagcactgcccctggaattggctgaggctttctttgaaagtgaaacacagctcaacttcttctgctcgggcttactgtctttctctccgtccgtccatagatgtgaatctcaggggcatcccataataaatatcctacacactaaatacctcctgaggggctgtttccgagggactctaacctatgacactatttttagaagtgtagaagaaaacacaagtgtagaaaggttaatttactctccctcagccacgtttaatgatcagtctttttaaccccagagtccacattctttctaacatactgagcttctcacactgggctatgtatcaagtcaaagttacaggatagatgtccctggagagtcaattttacccaattaccagaaatttaacacactctctcagattcaaaagttcatagtagagtgcgaaattcaatgagcttttaagaaaaagcatgatctttcaaaaaaatagtcttttatttattacaggcagctacagtatagattgccgtcaggctgcttggctttgaatccatgttttgctggttactacctgtgtggccttatgcaatttgctttctcttttgggcctcagcctctccacctaaaaatcaggttataaaagtacacattccatgagaatattgagaagaacaaaattatatcattcatgtaaacttcttagaacaacatttggtacatcttaagtgctcagtaagtgcttacaatcttatcaaagcccatcaaagcccattccctttcctctgtgtttagagtacttaattaactaattaactaatgcatctaaaaggattgcacaatgttaacataacgcacctcctctgtgcctcgattttaatttaaaactttatgctaataattttctgtctcctccaacgcaccccgctattctaaaaaccagcttgaatttaataataataatacataaaccctcaatattctcttatctcctaatgaatcaagtccaaacactgcaggctgctttccaatgccctttatgatctgaccctcatccagttttccagtcttttttctgaatttgccctgacaaagtggactactctagtccctgccccctcctttctttctgcaaaagtgcatttgctcaggttggttgccaaggttggaaagtccctgtccatctgctattgatcacctttaaggtcctctcagtctcagtttcttcatgaagccctccctgtcccctgcagcctgcctctgtctccacctccgctagcatgcattatctgggacagtcacttattgcagttgatccttttggtcaagtataacttgtacacacaggcataacttggagatgctgtgagtttgtttctagaccctggcaataaagcaaatatagcaacagaacaagtcagacaaactttttgatttccactgcataaaatgttatgttcatagtatactgtagtttattgtgtgtaatagcattatctctaaggaagagatgcacataccttagttcaaaaacactttaatactaaaaaatggtgacacagagacatgaagtgagtacatactgttggaaaaatggcactgatagactcgttcaatgcagggttgccacaaatcttcaattggtaaaatacataatatctgcaaagcacaataaaatgaggtatgtctggacaaacagactgtgagtgccctaagaacagggagtctctgttttctgtcttttcataacaagtactaagataaaaaaaaacttatagacattcaataattatttcttttgaatgttagtatttacataatcatcattttttgatattgtttgttctagttgagaaaaagtgtcagatataatttgaaaaaaatatgaagaaggaaaatttggtctcttctctgtagacaatgaaatccctgattttatgtagaaacatgtagagtctactgtgttggcttaatgtttgaatacacgcttaccatagaagaactcagataggaaaagtttaggaaaagtatgacccatcttttattgaaatgtacactttaattctgtgaaaatatttcaatgtaaaagaaatgatgcaagtaaatctgcatccattcaacaataaaatctctttttagggcattacaaaaggtaatgaggtcaagcaaggtaacatgtgagtttgtatatagtttcaggataaggagacaacagaaaataacaacaaaaaaaaaaaaccctggctcaagtctgtaatcccagcactttgggaggccgaggtgtgtggatcacgaggtcagaagttcgagaccagcctggccaacatagtgaaaccctgtctctactaaaaatactaaaaatttgcgaggtgtggtggtgtgcgcctgtaatcccagctactcgggaggctgaggcaggagaatcgtgtgaacccgggaggctgaggttgcagtgagctgagatcgtgccactgcactccagcctgggcgacagtgcgagacaccgtctcaaaaaaaaaaaaaaaaaaacccaaaaaacaaacaaaaacaaaagttaaacaaaatctaggctgccctgggctgaggatcttagaaactactttgatcagaagaaggacaaaaggagcttctgtattatttgttcggtgaatagtttgatctgaaatgaaaaagagcttaggccacgtaagattccagtgagaggtgatgaattggctagctttgggaataatcagtactgtgcattacaaataggaggggttagttacatctacacatcccagaacttttatactcctggaagatggcaggacaggcttatggctattctttgactttagctattctgttttgggggctctgtagtgaagattatctctaatcatcaacttgctgcttcagaaatgtgattttcaatcagggttcctagggtgctgagagctcctggatgtgtgagctgtacttaacggcaaagatctgaggtcagagttgctatcttcctatgtgtctcccgcccttgccttcctgccagcatctcttcaccttgtcgtgctttcagagcaggaactgacgcaaattgggtgttggactcccaagaaacgtgtcacagctatttagaaagtgataataatcctaatgccctgtaatgatttgaggattaaggaataaaactgcaaatatgatgcatggcatataaatgttgaaagtaggtgcttaaatggagacaaaatctgtgaaggagaccaactcatttggcattttcatattcttactatgtttagttcatatctatataacatagagaagtgtggatcctgcaaactaagacatggaggggaatttctttatacctgcaagaaaaaaaaattataaaagacattgaaactgaccaaaaagattactaggtgttgtgcagaatcctcaagatagctcccccaacattcaggtttcctagttatttgatcaagcattaattcaggtactccctaggaagacattttgcagacgtgaagtcctaagtcagttgaccctaaaatacagagattatctacataaacttaatctaataaaaccagcccttaaaagtggagaacagagaacttcgtccactggtggcagggggagaaacagaaagatccaaagcaagagaaggactcaaagctccattgctggtttgcagatagagaagattaagtgagaagtaataagggtggtctctaggagtggagagtgaccattgaccaatagtcagcaaggaaatggggaacctcagtcctacaaccacatggaactgaattctgccagtaacctgaatgagcttggaaggagattcttccccagagattccaggcagtagcccagcccagcaacaccttgattttggccttatgaaacccagtggtaaaggcagctgagataagctagacacttgatctacacttgatcataaatgggtattgttttaagccactaactttatggttatttgttacactgtaatagaaaactaatacacttggtgttttcaatggaccactaggctttgtttaaccacagccatcacagtttcttttttttttttgagatggagtctcactctgtcacccaggctggagtacagtggcatgatcttggctcactgcaacctccacctcccaggttcaagcaattctctacctcagcctcctgagtagctgggattacaggcacccaccaccatgcccagctagttttttttttttgtatttttagtagagatggggtttcaccatcttggccaggctggtcttgaactcctggcctggtgatccacccaccttggtctcccaaagtgctgcgattacaggcgtgagccaccgcgccaggcccagagttcttattctgtgaagtctctgtgcctttaactccccttgagtgagtgtacagctctgtaagttgtagataactgataacaatacaaatatttttgtctatagatacacacatgaattttatccttcagaaatacaacccccttctgccccatgcaataaaccagtattatatttgtcagttcacgttggcattactaatctgccaatatgtgagtggtactttaaatccttctttgaaccagttgtaacatccataccatgctaaagagttaaataaaatccttgatgtacttattttatatctgtataagagtcattattttacccttttataaaacatatcatttaatagagatacattcagagatttctaaaatttacagggcaaggactgtttattcatcccagagtttatgtcaaaaaaagagctaaatattgtacataagctcatctattcctcatgctaaacccctgaccctggtatgaagagtccctaattgaaataaagaaaccaaaactcaggcacatcacaaaacatactgtagagcacacagtgctggagtcttggagctgagaatttggcatactggaatataaagctactactacttccgttgttccatagagctttccaatgtaaaatggggctcatctcctttcaccctaacccagcatctcctccttatttcttcagtccattcttgatgtgaatattttcctcctcagtcaagtttgaaaacttagagccatttttgtcctttcatttccttttctttctatatccattggttatcaaatgccttaagttcagcatctaccatctcttgtagcctcttcctctttctgtttctgctactatcatctgagtttcttctcacactaatagcagctcaaataggcaaacaggaccagatctgagttttgggagtttggcacttttacaattttagagggccatctttagggaaaaaaaaaaatagtaatatgaatacaaaatgaaacatttattcagaatgagaaaataagccacaagaaatcaacaatcttagaacttcttatttctttgttttgagatctctgatggcaatttaccagaaatttttacatacaggtgattcctgactgtaactcaaaacccttccccgctctaaactccctgcaactccacctactcacaggggccatgcaaagaagtaaccctaatactcaggcttccgtagctttagaaacttagagtctctactatcaattctttttccatttttagtaaaggaaataaattaagcaatggaaggtctaacaaattattcagagtttcatggaggtggggagaggttacgaacctgggacgttttaaacactcagattcctgaattataacccaatattctaaataaaaacctgaggacatctgtatttttacaaggctccacaggtgaaatggatgcaactgacctatgaattacaaatttgaaaaccactgctctagctcaactgcatgaaaagtgacctgatcctctgtctccaaaggttaaagctttcagagtgcaacagagtcctccaatatttcctgggcactgtggtctgtacaatgcaaaattcagaagctataaaaaatggaggtgaaaagggccctgattaaagactgaaacagaagcaactgcttttctctctgtgcagctaccatactggtcttgattcaagtaaagcaatgtgcctgatgagaatcactgaagcacagaaaatggtctggtactgagagatgagcaaatgaatcccaagtatcaggagtacacaggaccagaaaagaagtatttccaatacccacgcctgactaaagatttcactagcctcttagctcaaagggacaatagataaacatcaggtctacactgcaaatttgcctgcatattaattataatttatttcttctatctttgtccttgcattagactgtttaattccgtgtatgaattcattttgaagtgtagagtccatcgttctcagtaattagctttacaaagtctatcatcgaaaatattgttttagattctttgaatacagattctatgaaagagaaaaatccttaaaagtgggagactcggccgggcgcagtggctcacgcctgtaaccccatcactttgggaggctgaggcgggaggatcacgaggtcacgagatcgagaccatcttggctaacacagtgaaaccccgtctctactaaaaatacaaaaaattagccaggcgtggtggcgggcgcctatagtcccagctactcaggaggctgaggcaggagaatggggtgaacccgggaggcggagcttgcagtgagcagagatcacgccattgcactccagcctgggcgacagagcgagactcgtctcaaaaaaaagaaaaaaaaaagtggaagaccaataagaattattcagattctactggccagagcaggaagctcagctaccagcatttatctttagactcctaccacatatgattgccccaactgaaacacaggtcagagagtctgctgtacttctaaagtgatgagaacaaatcttcctgtcactttatgtcacagtcatacagttcccgaatagcaacccatagatagagcccttggcaaatttgttatcagcggtgtgtgtttacacacatcaagtgtctgggaaataaagaaaaaaaggaaaatattgacagtgtagaggatgttctttcttctggaaactcataagattttgaaacacagctgaatattttgaacatacctttatgttcaaaataaattaggaaatgattcaatactaagcataattgaagtcatagaaaagcattttttattcttttgctctattaagacacatttcattgtttctcatggttactgagtggtacatcgctgtatatacatatttatataagtatattagatgtaccttttgtgtgtgtatgtatatgtatatatatgtggggggcatatatttatatatatttatagcaacatatactgtatacttctacacactttgctctccgtcctgggaggtggaccagaagggttaaaaagtgcctgtgtcctctggcttccggttgggctcagcctagggagtgcctggcctgagctggagggaggtgaggtattcaagatccctccctgaggcttggctgcaactgggtagggtacactccttgaccaaaggctacagttccattccttggacctatctacccgatgcccccacccccaaacctgggttccaataacttccctcttcactccttcagttctcggggaggcccagtttgcactgctgttgccagccagagagaccgtagctttccttatggtttccctacaacctttgtaaatagttcctttattaaactcttttcaaattacccaatttgtgtgatccgtatcttcctgacttggaccctgatatttttactgaatattgactagtaagtgtattgctcatgaactgaactgcttcagagttgttgagctcctaacacataatttattatttttctttattatcaaagtttttaaaaatgtatttactcctaatttctttcaaaaatagatttatgacaggaattattttgatgttatattccaggccattaaaagcatcaagtactttggccaggcgcggtggctcacacctgttatcccatcactttgggaggccaaggtgggtggatctctttaggttaggagttcgagaccagcctgaccaacatggtgaaaccctgtctctactaaaaatacaaaaattagccgagcatggtggcagatgcctgtaatcccagctacttgggaggctgatgtgggagaattgcttgaacctgggaagcagatgttgcagtgagccaagatcacgccactacactccagcctggacaacaaaagtgaaactccgtctcaaaaaaaaaaaaaaaaaaaaagaaaaaaagttcaagtactttgggaataatagtaagaggaattaaaaaaatcaagtactatttttatgaattctgggcattttcccctccaaatcatagaccaaagactactcaatgaatactcagtgaatctcttcatgttatgaaaatcaggaaactgctgcctaatggcttaacctttgatgtaatgattttcgctcagtagcttaaatctatgacaatgttcatatttattgaattctactctttgcctttaggctaaggaactatatgctttatgacattgtatattataaagaacaatctataccaaaataacaaccttcagagaacaaaaaacagaggatgctggagtcagcaattgctaagatactggacagacagcaaggtgagtaatggagttaataatctggaatatggaatactgacactactaaaaccatatttgggtgactaaattaacgccacacttctcatccacctacataatgtttacgcatccaatgatgatagttacgtttatccaatgtcaaggcatgcttacaccgttctgacatataatacctttaccaaatgctaattattttattaatttaaaaaatatttaaatataagaagtgaaattccactgtcaagatgcattattcattgtttttcctgtatcagttcaaaaaatattattcttaaaaaagaactggaccaaattccaactgtgatactacagaagaaaaaaaaaaaagctgaagtaaacaacattaagaaaggccaagtaaagtgacaaatcacagcaaataacaatttatccctactgaaaaggacagcacaattcaatttgccaaatcattttatttatctctgagtggcaatatgaatgatcaatctgttttgatgaacactaaaactttgctgaatgaaaaactgtgctgcctttaacatgtcaaatttaggtacagtaaaagaaaatgtgaattaaattggctttgagtatacagcattaaaagataaattgctagcttagaaatatctttcccagtagctttatttgaaccaaaatattttgcttaggaggaattacataagtgtgcaatctatataataattatttcttggtccctaaatttgaaatgttctcaaaagcctaaatgcagaaaaaggctaagaagattatatgaagagaaagatctggtttgatcaaagactttggctgtgaattagagagggttttatagttttgggataaacaatttagcaaaaccctgatattctttcttccttcatgcatttatgcatttaactgtttgttaaaatactcctatgtgcaaagtttgtcctaggaagtgggaattaaatattgaaaactctctgttttcaatagctccaaaaaccacataactggagctttaggacccatcttgtggctcctggaaaatgaattttaaattgaatcctgagagattagtaggagttatctaggtgaacagagaagggtctcaagtgaaaaagcttccagggagacagcaatgtctgcagaagtctagaatgagaagacgcaggaccattctaggagttccgagaagttgatttggtgaaagcaaatatgttaagttttgaaaaaggacatggttgacataaggcgagaccagaaaaaaaatttagaatgttgaggtgaaaaaattatactgtattagtaattagtcccagaatccctgttaggaaggaagctttggttacgaacatatcctaacttttagtccagaggcaagactaaggagagtataatgaagtaaagaaaagaggacgatgagttgctctgcattggaaatgaacagggatctatggtttggggacactggaaaaatgagaaaaggggaaataaaaaagcaggaataaaattataaagggaggacaaaggaattataaaaacatggattttaagttatttgtttcactgtgttggaaatgtccttttataacaccctaataatattcagtactagctaccacaaagacaaaagagagaaatgcatttgtagtgttttgtttttatttgtggaaatacaagttctatatctgttgtcatatcagggcaatgatagaattgcctgtcacggtcagtacgtagagtcaaatgttattcagcaaagagaggatgactctagcacttgcagaccccttggagatggtatgagacttttcacagggcagtgtgcagggattggagccaatcttctagttcaaaggagcatggagttccagcaaacacatagggtatgtagaactccagaaagtttgagactgatttaaggataatgggagtgttaatgagggtaatgcttggctccatttgtcatctggatacactgtaccaatggctgagagggaggcaggactgaggcagagaggccagttaggaaagcaagtatgttgggtcacttgcaaagccaccattgattctgatgttctgggatggctcccctgactgtgatctcagttcacctggttccaacctggggacacagaccaagtacttagaccttagtcaaagacattacccctgtcttagaggagggagtgatagagttgggtgattatgtgtgtgtttgcatgtatgcattggaggagtttataagcataaagggagcaagaaatatcaacatggctcaagtggttattcctctaagaccatttgtgagtataaaattgtgtgtgtggttacccacacaataagaaattgatgagaacttaattgaatcaaattagaaatttactagccccacattctgtaattctgccctggcagaaaaatggacctaaattcagactatcggtcttaatatgcatctaatgaagaagtttgaaataaaggcaatctgctgacttgggtgctttgaaaaaagaaaggactcaagttggccattatttcttgttaatcaacacagtagttaatgaatataaaatttacatccttgttacagtaacatttaagttacatctttcaacccattttgtatcttgttatcactcagttttgtttctgtctaaaaatctacttgctagaagggaaaaagagcctttctataatattagaagatttatttaaatagttctaaggactatggactgtaaacttaaaattaataatgtttgccaaaggaaatacctgtgttagaagacttgtgaaagaaacctttgttctttcacacaagagttaagtgtagcttgtcataggaggtggattttagccataaatcctagtgacactgatatcatcaatcgagtcctaagtaactctacctgtataagaaaatcatgattttattaaaattacaatggtaactaatgacttccacagtttcccacaatcacatcaggcctttacctcccttagtctacttgggctgccattaactaaataccatagaatggatgtcttcaacaaaagacaattttttttttttttttttttttttttttgctgttctggagcctgagaagcccaacatctgagtgctagcatgggtgagatctggtgtggcctctcctgctttgcagatggctgtcttctctctgtgtcctcacacggtgatgagatagagagcaagctctttggtttatagggggaccaatcttgtacaagggacccacctccatgagcccatctaaaacaaattatctcccaaaggcctcatctatcatcacattgaggattagggcttcagcatattaattttgaggggcacgattcagtccacagccctccctctgtgcttgtatcactgctttttcttccttgctgtgaatgaactgaatggtatgggcttttatctaaggacaccctctagccttgtgcataggctctgaaaagttctccttgcacagggacaacattgtcgggacttagccctttttctcctccatgctcaaatttcacttttctgttagatcagttccaacagcctgcacaatactgtaaatacttctatattgaagattaatataaaaacaaaataggctgggtgcggtggctcatgcctataatcctagcagttttggaggcagagatgggcagatcacttgaggtcagcagttcgagaccagcctgaccaacatggtgaaaacttgtctctactaaaaatacaaaaattagccaggcatggtggcacatgcctgtaatcccagctacttgggaggctgaggcaggagaattgcttgaacctgggaggcagaggttgcagtgagcccagatagcaccactgcactccagcctggatgacaaagctagactccgtttcaaaataaataaataaaataaaatttaggaaactgttgaccctacatccccttctaacttactgtctaatttcttcacttttcattagagccactcatctaatgtgtctatattcactatctctaacttcttttcttccattctctcattttttaaaaataaataagatcattatacaaaactcaaacaacataggaaagcaaaggaagtcttgcttctatcactgccccaccaaactcataatacaagccattttttttttttggtttctaatttctaattctttccacttttctaatgcagacatcaatatactgtataggcttgtctgcagtttgtttgtttttactcagatatacccaggagattttcccactgtcattatttaaagaatgagtccccaatccccaggccacagactgacaggtcctggtccgtggcctgttaggaactgggctgcacaggtggaaatgagcaaaagccagcggtgattattatcacctgagctccgcctcttgtcagatgagccgcggcattagattctcatacaagagcgaagcctattgtgaactacgcatgcgtgggatctatgttgggtattccctgatgatctgaggtcgaacagtttcctctcgaaacaatccccaccccccaaccctgtctgtggaaaaattgtcttttccacaaaactggtccctggtgccaaaagggttggggaccactaatttaaagaagttcttcattctttaattttacaatggctgtgaatggtcatcattgattcaactattccttacttgctggacattgggttgttgccattacaaacaatatcctaattaactccttaaacacatggcatttgatatttgcacaggtgtatgcacaggctagactcctagtagtagaattgttggctcaaagggtaaatacatctataatttatttcatacaatactgccaaatttccttccgtaggagttgcaccattttcaaatgtcacaaagcaacatataaaagtatttattttcctgaaaccttgccagctgagtgtattttcatattttgtatagatagatgacaaaaattgtattttcagtgttattttaatttgcatttctattatgaatgacattgagcactttttctatgtggttaaagggcattagtatttctttgttaattctctctctgtccctctctctctctctctctttatatatatacatatatatgtgtatatttatatatatatgtgtgtgtgtatatatatatatatatatatatatatgctttacttgcttttctatgaattgttggttcttctcaatttcttatagctctctatatactaaacaaattatcccattgtctggacaacaacatgcaaatcataaatccatctatattttgcttatcttgaatctggcttcctagaacctttggaattctgggaaaaccccagattcaaaaagagcttagaaacacatattttaccacctcttgggagctaaaagtacagctccttgagcactcagtcatgtaaacatgactacaaaaagccaaaggtacaaaatcacacatcatgagttctttcatcaggtatatccactcagtacccaccatgggtggtcaggtagtgctctaagtatcagagacttacagccaaacacccacaccgtaactcaaggatttacactggtcaccaaattgaagggccagttagtagttaaaaaaaaaatggaaaaaaaaggtaagaaatacattgactggcttgcagtacaaaaaaaagaaattatcctattgctgtgatgatgaattgcatcatctccattattcttcgaatttattgcaatcaagttgtttgcccttatatatactaaaattttctttgtcaagatcaaacatgacttctatgtagccaattctaatatcaattctcagttcaccactaagtgataaatggtttacatgatggataccccagttacccagattggatcatcacacattgtatgcttgtatcaagatatcacataaatgacacaaatatgtataactattatgtattcataaaaataaaatattaaaaactaaatcccccacagaaacttaaggtaaaacgattcccagagtatatgctgaatggtcattatttattgtatcttcaacccatttctgaatcatgcccagctcttatgttatagcacattttcattgcacaacccctgtgtcatcctctattgctaggattctcatttcattcatgttggaacagtgacctaaagagcttaaatgtgccattatcagatctgcaatggagatgaacacttgcctatgcaacatccatctttgtttataataaaccaccatttatattaaaagtgataatcttcccaattaaatattccatatttcccaatatgatacagctgaatctagtcctctgggaaaatttaatctatggtatgttagaagtgatgtgtgggactttaccaaagctctttaaatggaactccttcagctgagagtcatgccctccttgacttttcctctttttgtctttctgctacctggaatgtaagcataatggctggagctccaacagctgtgtttgaccatgagctgaacttgtgagtaaaagctatgttctaggacaggggtttccaaactttctgtaaccgacaaaataaatattttaggctttatagcccacacttgctctctttcatatttttctatttttgcttgatcttctttttatatactcctttaaaaagaaaaataaaatttttaattttgcagtccctacaaatgcagtctgggccagatatgcctgtgagtcctaatttactgagtcaccttactgtaggatggtgggagagaaagattagagagtgcctcatgacagcagagctggcatgccagccctattttgcgtacctccagacttcctttatgagagagaaattaatatccatcggtttaagctactgttactttgtgttttctattatgtgcagataaatgaatcctaactgataaatggccttcgaaggaaatgtacatattgcctctgccaaggaaccttagaagacattattttaaggagaaatactataaatacaaaagcatgtaaataggagaaaatttcaagggcatatttacaagagaaggttgaagtgaagaatcttctctggagggtatggaaagacgttttgataaatattattccattgatatgtcaggtgaagctagttgattgcagtcctgggagtgaggaggagcagtttgaacttgattcattagttaataaagagctattggacgttcttaatcctagtgagggcataagaaagccatcattcggaaggagtcacttgtcagtaatatagtctggactggaacacggaagctctatgctggtgatcctggagggctgaatctcaaaagtttgaaatgacaatagaaagaaaaagttgattctgagagatgttaccaggtaggggcagaatgagtggactagcatttgttagataaatgcatgtaaacgttggcagaggagggaagagttggctatatctgcaggtaataaatttctgctcttataatgtttataactatttttgctcccttgcttatctatctattattttctatattgtacacttatttcaacagaacaattcatgcttcaaccctcgaaaaattgtcattggacacaactttataccacttagctgagtttcctaatctctttcaataaataggtaagcacagaaccccagttgtagctaaagattcttgaatttattcaggtcaatatattgattaagtaataataataataactcacaatttttaagagcatggtatttgacagatgttacagactacatagattctgtgttgtcttcataagaatcctattagatggcagctgtacacagtcagcttcaccttcaatattgtgaaacggttgcttggaagaagctgtctagccaggaactgcatttccctgtatccacaccattttggtgaatgctcatgactggattttaccaatgaatgtgaacaggaatgttgttaatagcttcagggctaaaatggttatgaaagtgcaagagatgctctaaactgtctttctctgctcaaagagattctaggggatcatgaaacaattatttggagacacccaggatcccagagtcaatgcacggaaagagctatgcatgagagccacctaacacatgtaaaactgtgacatacatgagaaatatacattaattcccttaagccactgagatttttgagccaaggctggcctactgtaactaacacagtaggtgttattaacattaccatttatacaaacagaaataagacttgggaagatctgcctaagacactaagtaatagagctgtgattagcatttgaaatattcaatttcagagcccatgttcttaaccattgcccaatatcatcatctttttatataaatttgtaaaagtggtgatactgttttttttaataaactaggaagaaattctaaactcctatattttgaggtgtgttgttcatgttcacaaagccccatagccaactaataaggtaatatgcattactaatgggtaatatgcattctacattaaaaatggcatttgctttaaggaattcaatgatctaggatttaaatattttgttccaagtttaactgataattccccccaagcttttctcattggcacaataatatggcttaggggaaagtatgaaggctgagtaatcagaactgcttggatcagaacatgacctcttcggccttgagtaagacatgtaacctcgctgaggcttcgttttactctctgcaaaagacagttaacatcaccagctttttaggataattctaaatattagaaataatgctggaaatcttaataaatcactcagtacacatagacagtaatttaattcaatcaagaactatgtatttaaatgtctactataatgcatgccagacattgttgaggctccaaagatacaataaacaaaacagacaaaaatcctcacctatttgcattcaatgtattcttttttttttttctttctaacagttcataataaaagaaaccaatattaaggcactttcaattctgatcaagatggagtaacagggacaagatttacattcccatccgaaacaacaacaaccaaacaggcaaaatatattagacaatagtttaggaaacactggccattaggtaaaatagatagtgatctcggagatacctggaatgaatgagatgagccctacaattgcccaagcaattatgagacaaggaagaatgcaaaatgagattggaaaatattttaaataaaaaataaaaacacatgatatcaaaatagcaggattctactaatgcaatatgtacacagaaattgaatcactaaatatctatgttcgatagcaaaaaagatatcaaatcaatagccttaacttctaccttaacaataacatttaattagaaaaagaagagtaaattaaatcccctgtaagcaaaaggtaatgatattaatcagagcagaaaacagtaaaatagaaacagaaaacaatagaaaaaataaatgaaaccaaaatgtagttcttttaaaaaagtcaatacaatcaataaacctctagccaggctaatcagaaaaaaagagagaaaatacaaattatcagcatcaagaaagaagggacataactacaaatttttctgatagtagagaataatatagaaacattgtgaaaaaaaaacacgcatgtgaaatgaacaattttcatgaaagataaaaacaaccaaattttactcaggaagaaataggtactctaaataaccctgtatctgttaaacacattaaagttacagttaaaaaatttctcacaaggaatgttctaggcccagatggttttgccttcgattctaccaaacatacaacggggagattatacaaattcaaagcaaattcttcctgaagacaaaagaaggaagacttccacaaatattctatgagccagcattaccccagtatcaaagccagggaaaggcgttacaaataaaaaaaaatacagagtaatatctctgatgaccattggtgcaaaatttctaaagaaaatgccagcaaatcaaatctaacagtgtataaaatgataatgcattatgatcaagtggggcttatctcaggaatgcagttagtttaactttagaaaatcagtgtctgtaatttacaatattaacaaactaaaaaagtgattatttcaatagatactgaaaaagaatttgacaaaactgcaatgtgaattcctgacaaacactctcagcaaatcaagaacaaaaggaaacttcctcagtgtgataaaaagcatcttttaaaaacttacagctaatttaatggttatatttaaaaaacttaatattttccctctaatatcatgattatgagaagttatctactcttacctgttcgaattgtatagtgcagattctagccagtgcaacaacaaaaaaaagaaatacagtattgagcatgaagaagatatatttatttaaagatgacagaactgtctatgtataaattccaatgaaatctacataaatatctaatagaaataattgcatgcagtgagactgcagcatacaatatcaatataaaaataacttccattaaattgaaattaaatattatttataatagcttcataaattgataacttagtaaagttatcaattttccccaaattgatttacagagtcaataaaatccaaaccaaactcacagcgggcattgtttatttggtagaaatcaacaagctgatttgaaattaatgtggaaatccaatgaatctagactagccagggaaattttaaaagaaaagaaagaacaaagttggaggaataacagtgccagaattcaagactgattataaagctacaattattaatatagtgtgtgtcattggtgtaataaaagacaagttaatcaatggaatagaaatggacccatgaatatgtagaatattgatttttaataatgctataggctaagcaatggaggaaaatatcgtatttttagaaaattatactaaagatatgtttgagggggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagccggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaaccatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaactaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagttttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagccctcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaatcatatgtttgaaagcatcaaaaaaaaaaaaaaaaaaaaaaaaaagaaaattatactaaaaattaggtattcaaatgaaaattatttaattcatacctcacaccatgtacaaaaattaactcaaaatgcatcatagatctaaatataaaatgatacaacttctagaaaacaaggaaaaaaatcttagtactcttggattaggcaaaggttttctagatatgagaccaaaaacataatccataaaaaaattaagtgggactccattaaatttgaaaattctggtcttttaaagacactgacaggaaaatatagttatatagctaatatgggggagggagtggtatggattgaatgtttgtgtcctctctaaaattcatgttaaaactaaatttccaatgcagcagcattaagaggtgcggcctttaagagatgacttggccatgctggctctgccttcatcaataaattcctgccttagaaaagtcttgagagcgtgagtttacctctactgtcccttccaccttgggaggacacagtatttattcctctggagcatgcaggaacagggcaccatcttggaagcagaaaacagcccttaccagacactgaacctgcagacaccttgatcttagacttttcaacctccagaactgtgagcaatatatttatgctatttataaattacccagtctaaggttttttgttatagcatcacaaatgaactaagacaggaagaggagaaaacttgtacttagaatatgtgaagtgctctcaaaactgaataataagaaaataaacaacctatttaaagaatggacaagagtttgagcagacacttccaccaacaaagatgtacaaagggcaaataagcacaaagaaagatactccatatattagtcatgaagaaaatgcaaattcaaccataatgagatactgttacactcctggtaaactgactaagttaatattctgatcataccaagtatggtgaggaggtggagtgacaggaatgctcacaagtgctagtggtaaagtagtttatctgtcttctaaaaagttaaacatgcacctacaatatgacccatttatcttactcctagggatttactcaagagaacagaaagcatatagacatacaaaggcttgtccacaaatattcataacagcattattcataatagccccaaagtggaacaacccaaatgcccaacaagaagtgagtggatggcctggtgcggtggctcacgcctgtaaacccagcactttgggaggccaaggcgggcggatcacttgaggtcaggagttcaaaaccagccttgccaacatggcaaaaccccgtctctgctaaaaatacaaaaattagccgggtgtagtggcaggtgcctctaatcccagctacttgggaggctgaggcaagagaatcgcttgaacctgggaggtggaggttgcagtgagctgagatcacgccattgcactccagcctgggggacagagctacactccatctcaaaaaaaaaaaaaaaaaaaaaaaaaagaagtgagtggatggatggatggataagcaaactgttgtacatttctataatggtatactatttagcattaaagtggaatgaaatattgatgtgcacagcaaaacatctcaaaataattatatataagaagccagataaaagggtacacattgtgtgatcctatttatgtaaaattgtcaaaacagaaaaaaacccacaacacctcatgtagaaaacagacccatgttttcctggggaaggtggtgaggagggctgggagaaacaagagaaagttccagggatgatagatatatatgttcactactttgattagaattattttacgagtctatacatataccaaaacttagatactttaaatatgtacaatttgttgtatgtcaagtatagcttactttaaaaatgtaaaactataagacaaaaagaattatcatttagaattttttactgaatcaaaatattttgcagatgcatcgaattctctgcttcctatcatttagtcaaccatttgcagaggcctagagatagttttggcatggaatagatagtgtcttttcatttagcatggctaacatttaacttaaaaattgtaaagatactaacagattagaagttaaatgcttattcgctgataacatcttcaacattgagattcaaagcattgtgccccttaaagattagttcaccactggccatcagtagccacttttatttaattatatttataaaatttaaatgaatcaatgctcttgcctaagaaaattatacccaggagtacagaatgaaaaatgaaagtcctcctgctcatttttcatttctaagtacttcttcacgattaacaatgagagcaaggttgacaaagatgatgaactgccatttctaatccttcctggcaattgcattcacttattttcttttgtgaacaggaaagtacttggagagaaattatacagtgattcatggttctggggaaggctgctgatattttgatcaggccacctcagtgccctcaggaaatcaaagtgtcctatcactctgtatccattatcattacaaagatggtctgcttttaaaccatcttgatttccaggtagtaaatgattttttaaataaaaggtgtttctaaaagtattcatttgtactttttcttcatcaaaagagtattatttttattttaggaaagaacaactggagagaaagagagaaaggcttcttgcatccccattttatttgcttttaatcgttgcctttaccccaggcttcttggtaatgtgatggtgttaactaggagtccttatctctggggcaatgaccacaaaaggaaagtttagtagtagtgtcagggaaccacaagtttcagactttagtagctgtccatgaagattgtttagctctatccaacactttctgcaacttgatggccatagtttcctgagtctgagtctttagtgcaccaaaaagaagtatccatacctggaaaagtttctgttaggcacaggtatgcagattctttctttaaccataggctagataggctatggaaatggatatgcaaataaaggacagctttaccgaaactatctaaatttttctcttatatccaaagatctgttatcctagggtagctggagtcctaatttccaaaattttcagaaaagaactcaacaaccaaagaaagattagggagataactagtatctactgagtccccactatatgctcacacagaaacttatatttgtaaatcttatatctcaaggccacattagtctggaaaaaaataaagtggggtcaagacaagaactagcaacagcatatctgcctctgccttcactgtctcttgtaggatctctacactatcttctttaaacatgatttgctagcagttctgggagtcctctggtgtagctcaaagatgctcacagagagcatcctctcagtatctcgaagcatctgccaattccttcctcctggcttatcagtctttgatctatgacggctatcagacctgctgaaagtcatgaaacagctaaactacttccactctgccaatagccctagggatgttgcattcacaggtacatttatttaaaaattctccctgtgaagagttgatgtacgtgcatgttaagtcaacctatagctacagctttgaacagttatggctctctaatcaggaattaaaactctattttgttgttgttgttgttgctgagacagggtgaagtgcaggctggagtgcagtggcatgatcatggctcactgcagccttgacctcctgggctcaagtgatcctcctgcctcagcctcctaagtagcgaggactgtaggttggcaccaccatgcccagctaattttttattttgtgctgagacggggcccttctatgatgcccaggctggtttggagctcctgggctcaagcaaccctccctcctcagcctcccaaagtgctgagattacaggtgtgtaatctcaccacacccaggctgaattaaaactctagagatggttacttaagcacttaatagtgttatcagaagttgtgccagagggtttactggcaaaaatagatattagaaataagttttaattgagtaaatgaggttctaatgctaccaaattcagtcacagtcttggaaattctctatttggttttgtttgggtttcatatgtatgtagtcatactttatatttgtgtgtgtgtgtgtgtgtgtgtgtgtgtgtgtgtgtgtgtgtgttttatagtgcagccctctccttaggcttctgatatgagaacctgggcctgaacagaaggacatcagaatggttcgtcccaattagtactcaaacactcccagcctttggtcctgattttctgtattcacaatcttttgtgcaatctctactttgtattaccttaacagagttatttcccataataatttcttttctcttaagctttagacctctgttaggcccattctataatgcccacacatgtttataccaaagaagaacactcctatttctgtggaaagacaaattaaacttctgtctatcagagccttagtaaatagaagttcaaaaagcagagtttttataggaaaagaaggaatcttgagattaaagtgcattcaaggaaacaccaaattatatttagtagagctttaccagagatttatttttggaaattgttctgatagtcaaactagatagtagattccccattcacggagttctatgtggaaatactcaaaattataggttaagcatggtagatctttcattagcatcaattttaccaagctatttttgccaggataaagggaagtatttttatataagtaaaaatagtgtactactgaataataaacataatttgcttcggtttctaacagaagtctttgaagaaatgttgttttcttggttagccatttagtgtaaggccccagacttttctggaaaatttaggtaagcactaaaaagcaatatttgggattgtcagcaaacattaaatcactgtatctaaatatgaatcttctatattttaattttaaccatgatccctgcaatttgaagtgaggtaagaggaagagaaggaaagatcatccattttaaagaacaaagaggccaaaacaagcaatatcataataaatgtagcatagaattatagagaaacctgaattgaattacattgtgattgctcagtattatatcacagtcatatgtattttaagatgaattgctggggttttaattaacatgtaggaaataaaacagtggaaaataattttaaacatatttataacatatatgataatacacctgcttttaataagtcagctgaattacatttttgtatgtaaaagttaattttcctatttcatagatatggaagtttgatttgttttctaatttttctttaactccttgcattagatgaatcctatatctccaagtactatatttagtcaagtagatttcctttttaagtgaaaaatgggttttgagatagaaaagagctttgccttaatatgccaattatacagctctttttaactctaacttgtagtctgagagatggtaagatttttcagttcagttgctctcaacaactgagatattgactgactcaagtttgagttacaaataaatctacataaaaactttcactttattgattcttttcaaaaacttctaattatgctttcaggtggttaaatggcaaaatctaactgcatctatgacaaagtgagctatattaaaactgtgggataaaggagaaaatgactactaaccagtgggcaactgtcaacaatacttccctaaaacaactgttgacaagctgctagacaaatgtcaacttagatgagttcaataaaagtagatcctgcagaatgagagggagtccctgtgttggcagagaggagcctgtctttgttagagacagaatactaaaactgtgctgatcttgggtggctgtacccaagaattcatcctttcactggacagtttccaagttattgtactttataaaataattggcattatcatgtttccatatactaagtcaatataagtgcattttcagaacagcgatgggatcagatttcactcagaatccctctgtcagaagaatccagaactcacaaaatcctattgttccaattaagaacatggatttgggaacacctggatttgaatcctgcccttctttttagcttggtgaccttggccaagtcaccaagtgatcctttatttgtagaataggaatagtcatagttagctccatgttgcccgggaagaataaatgtagtgacatgtgtgtgagatcttagtagagcacatggactcagcacttgctcagttcatggtagctctcaacagcctccaagacacaaggagtcagctgacatttctataaatacttgtctcagctcttgggcaagtgggaacttgtgttctacaaactctgatcattgaatcgataggatttcacttagcatagttctttaactttcctaggagccaacatctactgagcacttaccatgtaacaggctctattctgatgttgttttgttttgttttgttttgagacagagtctcactctgttgccaaggctgcagtgcagtggcgtgatcttggctcactgcaacctctgcctcccgggttcaagcaattctcctgcctcagcctcccgagtagctgggattataggtatgcgccaccatgcctggatggctaatttttgtatttttagtagagaaggggtttcaccacattggccagtctggtctcaaacacctgacctcaagcaatccgccggccttgacctcccaaagtgctgggattacaggcatgagccactgtgcccagcctattctgaatgttttaactgaattaatccatttaatactgatatgaactgtgtgagatagaaagtaaccttattttacagagaaaaataaaattatgttataggattgccttgtattgaaaaactagtggggggaagagatgggattgaaatgaaaataatctaacacataaacttgtgtctttattgctacttttattgcctctcctactgagatgtaatgtccctaaggaaaggatgattttgaatgttttgatgtcctccaagcacttgacatgttgtcctggcacagcatgcatgttgttctttagggatctcccaatttatttgaggagattcaatgtgcaaggatggtaaaacataatggcatttataaagccccactctggtccaagtattggattcggtggcttattggcctcattttatcctcaaactgactttgaaccataggtgtgcttacccttatctataagtcaatcaggcttcccaggtatcatacagaccccactccggtgtgtttaaacagaaatggaattcattaaaggtagttctgagaatttctaagtgagctggagcatcatactcagatgattcttggtcaagttcagtgcccaacctcatccccaggactgcatacggaagcggcactacagctcgtatggctaacgctgaacattgaaatcactgacactgtttttcttggcatctgctggctttaccacaacccttgccaggaaatagattctgtttcctcacttccaaattgaagtcttccaagagcgcatctgattgatggaggcttaggtcaaacatctgccttaactgcaagggaagctgaaaaaagtgtgtgaatttaaattcagagaagcaagacttgtaaactgagggaatttcctgattacaggaaagatattaaaaagtgctaggtttgggggaaaaaaaaccactttgtaaatatccactacacttccattttacagatgagaagactaaagctcataggttagatcactgagtgcatatcacgtgagtagtaagcagaagactgagcatatagaggcagacctgtctccccacacaaagaaataacaaagcgatgagaggtttcaacagtcaatagcagagcagttcaggggaggaaggctcccttccgggtgcggtgatcacaaaaggcccaagcaaagtaacatcatttggacagctccctagaatcctcatctcaaggctgtaagaaaaatcttaggaatgatttagtgcacattcttcattccacggaggaggaaactgaggcttgtagaaaagaattgctctgcccaaggtcatagcctctttgtggcaagtagctgaaaacccaaacccgtgacagtaggtccagtgctctctgcagcaagccgtggaccccacctgctaaatcacatctctggcagaactgtcgggcagactttctttgaattgacaaacagaatgggagagaaagtcacgtgcttcagtcaaagcaaaaaagaaaagcttttattctgtatgtggtttctcatagaatacttctcgcccagctgcgcccaagtaggtaaaaggctcttgcttatgctaaggagcctttcttatctctgcacaccccactcctttcctgctaataccaagtacagaaggcaatgaaagaaaaggtcacctgccttcctcctaatgggacactgatgtttttaagtgctcacgtgatctgtcccagaaaatgtcaaattgttcccttataactctaagttggcggttagttgagtggctctgttgtccagacaatggatccactcaatttttgcctctcatttgaacacccacatttaaaaaaacttgggaagaaaataatggaaaagttgacctctcagttttccggaaaaggtgaccatacaaatgtgtcttttctggctgtaggctttatgaaacttctgagaagaagcgtggtattttagataaaaacaagggtttggttgttagactgtcctgtggttgaaattcagctctatccttgctggtgtgtgatcttggacaaaagacttaaacttcctgagactcagtttgtatgcaaaatgagaataattataaatttgtaggggattagaaataatgcagattcttgacatttattatggacttgttatacatgaaggattattagtttcactctttatttcattaactactttgacttaagctggtctctttgatgaactttcattgactctctggtacttgacatttgtataatattactttcaaaaatgcattagtaggctgggcgcagtggctcatgcctataatctcagcactttgggaggccgaggtgggcagatcacctggggtcaggaactcagatcaagaccagcctggccaacatggtgaaacctcatttctactaaaaatacaaaaattagccaggcctggtggtgcatgcctgtaatcccagctacttgggaggctgaggcagaagaatcacttgaacccgtggaggttgcggtggaccgagattgcaccattgcactccagcccctgggtgacagagcgagacactgtctcaaaaaaaaaaaaaagaaaaaaaaagcattagtaatatgttaactcatattattttcagcaagctttttaaaatatgattttgttacttttttttacagataaggacactgcattgatgagtccttaagtaactggtgaccaagatggccttaatgtctccctcagcttgactaaggtttacataggtttctttttgactctaggccactggcttcttttttcttagataatttacttaaaaaaaaaaactctgcaattgtaaattatttctctacaatctagagatgtctttctcaaggatttgggactaatttccttgaagtcatagaagaaaataagatgcctatcttcctatctttgggagggtagaggatccttagacaagtgacagccaatacaaatggcctaatcacattgaccaactacagtagtcctcccttatccttatccgtgagggatatggataattcatttcagtaaatgcctgaaaccacagatagttctgacccctatgtctattacacacaaatttctttttccttcacaatttcgtggatagaagattcattcttaccctagattttagcaacttcagcatacgatttttttccttaactagacaactttcaccttttcacccaaaggaaatactttatggcttctcattggaatattcaaattgccagtatcactactcttgtgctttggggccatgattaaataaaataagagttacttgaacgcaagcactgcaatacttcacagttcatctgataactgagaagactactaagtgacaaagggaggattcatgtcccaagcaggaaagagtgggccagggtaagattttgacatgctacgcagaatgccatgcagtttatgacttataaattgtttatgtctgggattttcctttaatattttagatggcagctgaccacagataaatgaaactacagaaagggaaaccccaaataagggaggactatggtatacctctaccgtcttccagtacttttccattagctcatcccagagtttaaaactcccatttgtttttttttagagttgtgttcaccctttctctttcccattgcaataatcttgacctctactgaaatagtccagaataaaacctttcttgcctgtctaacttgtctgaggcaatttcttttacactggcccaaagtcactgaattagacaaggtaaagctaagatttttagtcaagtcatttgtgtttttctcatatggacttaagttgggctttaagaccaagactgcagaccaaatttttattctaagaaaggcattatcctggaatcacaatctaactaaaacagcctttgttttctcctctgaaaagtgagaaagctggactagattcctgtctcacagttggatcttggagatccttcacaagccttgatggactagggaagaggggaccaaaagaggcctgactgggggctccacaatcatgcatgcttaataaataaataaaataaattggggccatatgttgacctcatcaagaagggtggatgctgctacaagtaaaaaaatggaaaatcactggattctaacatttatatggcctgttctagctctatttattttttatttttatttttgtgatggagttttcactcttattgcccaggctagatagagtgcaatggcacagtcttgactcactgcaacctccacctcccaggtacaacaaactctcctgccttagtcacccaagtagctgggattcaggcatgtgccaccacgcccagctaatttttcctatttagtggagacagggtttcaccatgttgctcaggctcctctcgaactcctgaccttgggtgacccacccacctcggcctcccaaagtgctgggattacaggcatgggccaccatgcccggccttgttctagtaacactagctccttcctaggacatcaaaacaaatccagcacacctgtcttttcctcagagcctgctttcaaagttttatctatctcacatgtttacatgtttatctaatactgttgctgataagcagatattcagtgagtaggtactcctcagacactatctatttacattttcattaaacaggatctactttggagataatttccaagtcaaaaagaagaaaagcacttaattgataggaattccagatccctgaactaggatgacaggtgcaattggcttattcactcaagagttattgaatgcctactatatataggattcaaatccctgcattgtgtagggatttcaatatagagttaaaaaaatctggcccgtggagaatacaatctagtaaaagagatttgctatatactcaagcattctcaaaatcctaaatttaaggaagaagaattgctgatttagctttttggagttttaattcaataagaataaacacaaactatgctcaaggtatcttaccaaaccatatattacagggaataggagatgagattcacagaagcaggaaagattgtttacctttatatctcttctctccttcaactctctacttcacacctatcttcttcatagcagggctcaaaacatggctattaaatgcgtaagtaaatatttaataactacttcctgcattaaaattatattacatttggcaaggcacagcggctcacacctgtaggggtcgcagcattctgggaggccgaggcaggcaggttacctgaggtcaggaatttgagacaaacctggccaacatgacaaaacccggtctctactaaaaaacaaacaaacaaaaacaaacaaacaaaaaacaacaaaaattagccgggcatggtggtggatgcttctcaggaggctgaggcaggagaatggcttgaacctgggaggtagaggttgcagtgagctgagatcatgccattgcactccaggctgggcaacagagcaagactatgtctcaaaaaaaaaattatatatatatatatatataaaatataacatttaaaaagaaaaatttaaacaaagtttgcaataatttatcccccatgttttacaggttattatacttttccaaattaaattcaggattcaactgctaatcttggcttgagcaagacaaatctattagcatgccccaggcaggtttatcaaaaacatctttttactattaaagcctcaacctacttcagctacaaatccctgcagacttacttagcataaggcactatcatttctatcttcattacaacacagtttaattatctgccttagaaataaggttcttcctcttaatgaaagtggttagtctggtggctccaaagggcacaaggcagtttcaaggcttaattctgattatatatgcaattacaagttagaaaatatgcttgaaagtcaatgaaagttctttcatctatttctccagttagaaaacataaacattggttggaacgaagattttgttgttgatgttttacttgtctagagcattgcttttcaaatttgaagatggcgcttccaggtgtcacttagtgtcatctgatgtcagttccatcgttactggggttcacatgaaggtagtggattcacagacctcagtttatttccaggtatagtaaccatgtgtccaggatagttatttaagtcccatgggtttaactttctcatctggagtcctactttttggggttggtgatgatatttaaggaaataataggcatgtgattggtgagaatgttagctagtaattatattacttcacttaacttctcccttccaaaactgcctattctaagtgtttgcttcctcctgtcctgtcgtcagccatatttctaacatcccattctcatctgaggaccatatctcctgtgtcactgagaaaaggagtcaccagagaactccttctagttttctgtcttctaacaccaaactttttttttttttttttttgttttgagtgtctcattcattgctcaggttgcagtgcaagtggcatgatctcagctcactgcagccttgacctcctgggttcaggtgattctcccacctcatcctactgagtggctgggaccacaggttgcaccaccatgcccagctaatttttgtgtttttagcagagtttgggttttgccatgttgcccaggctggtctcaacatcctggactcaagcaatccacctgccttggcctcccaaagtgctgtgattacaggcgtgagccaccacgcccagcaaacatctatattttctattatctttccttctcccttttcatctttaaggaatttggaccccatattctaagactcatttctcagcctgggcttttgcccaactcatttgaccttcatccagaccttctccatcatttttccttgcttcttttagtgaaaccttgcactttctgctcactctggttcatttccctcagcttcaaacattgagatcatagtagccagattcagttcacaaagcatccttcacataaagttttgctaaggaaataacaaagatgtgtacaaagatttttgatcaaggatagccattgtggaaatatagtaggaagcattggaaaatgccccagtggtcaacaatataggttagctaaataaattagggcaatattggttagctaaataagatggggtgttttagaaaaatagaaaatgttatgggaaattctttagtcatgggtaaatatgtcaagctggtattaagaatcatataaatgcatgtgatgtctgcaggcaggcacatgtgggtgttatgcattgaaaaatgcatacatgctatttctggcttgtgagatacaggctaactttaattttctttgaatttccttgtattctctaaacttcatacaaaaaaacttattttctttctataataggtgagaaaacaatgttttttaaaaaatgcttctttgcccttgtgtcctttcaaatgtcaactcatttatttctttctcttagctatctttctccttaaagtacagtttacataagctacctccttccacttctttcctgattatttacttttcaatctaatgccagttcattgagcccccatcatgggtcatgcactgagcaaagcacagagcaagtcactgaggatacaaggatggtggtggctgaaaaaataatgtttttttccatcaagagctttaacaggctgctaagaaatgaagtactctctccgttgaatctatcccaagaaataagtccacaaagaccacaaatataccacaatgtttatgataacaccagtttaataagtacctaaaaatgtaattactgaaactctcataaatctcacttctgcatcattccaaaatccataaacaaacacaaaaatgctcttaaagtaattccagattaataacatgaatcaagcttctagtactagagtttatgactagaatcctaataatagtttttcattgatgttgcttaaaaataagaaaaaagattgatttatagtaataacatagatataaatatctgtatccctagagttctgctttgcaaatattaaagaatttttttatggtgagaaaccaatatacatttattagataatacttgccaataagtaaaaagtaaataaaataagaatcacacatatatatgagtataaattaatcattttggagtggaatttacagcttcagtttttacagatagtttctttctttctttcattatctgggttaaacaaaggaagaagaaactactgttggcaagttgcaatggcttctttcctctaatgtttatatgtgtgtgtgtgtgtgtatttgtgtgtatatataatatatttagtatatttgtgtatatatatagtatagtgtatttgtgtatatatatttgtgtatatatgtgtacatttagtatatatatttgtatatacatacagacatatatatataaatcttatccttatgtagtgaatacaatactatgtgaatacactatgattatgaagtgattatatagtaacattctaatctcctggttatgaaaaaaatacttaaaagtttatactgaaaggggaggatgtgttaatctgttttaagtttaggctacaggcagaatatgacttctcccaaccaaaggcaacattcttgctaactttagtatatgttaggtttcaaataccaagaacagaacttggaacaacatggacatttacagggcaatcacagtaaaacctgctgcagtagaggcacctcagatggatgcttaaccagccttataggtcaggaatatcctcctgagggaaatagcataaagacatttaagctgagtcttacaatgttagctagtctgagaggaaaccaagatagggtgacaagtttttttttcccacttaatatcatttgattaagtgtccttgatttgattaagtgtccatgcttggctccaaacatggaaactgggaagctaaaaaatagtcattctctagacattaaagctgcagcttctcttaaggctgattctcagtgatattttagctcttgatcacattaccttaccgggtttgatcatctctaagattctactataggtgggagtatcacatggattgcactgactttcaggatctttggattctcatccatacgttcatgcatccatccatccatccatccaaaccatatgtactcatatgttgaaaggggtcatggttgataccatggtataatgagctgtgaagcttctccatttagggagtttttcatgtaataggtagggctaagtcgagtgcatgtggcaggcacaagcagaatctgcagaagttctgagagtccatgtaatcgaaacagtctcctctttgacaacaaggcagtttttcttctgacttcactgcattcattacataccattactacagatactgtaattctttcctttgggcctttaacattctctgtgggaacattatttatcaaagagtaaaattttgaaacttaataaaacaaacataggagagattcatgactaacactggtacaatagtgcccttgggtcaaacatttgctttactaaaatgccaaacagtctccagtttctaccaataaaacatgacttcatttgctttcagcactgttggaatgcctctactatagcccttagtcagaggagatataattatgactatagcttcactgatattggatgttataagtggacattcagaccaattagaaagaggaatgtctgggaaagaacagtcaagggaaggaagactgttggccttgcaacaggagacctagccaagggtatttgacacattagatgcaggatgcctagtgaaataccttgagaaacaatagtgaagctatgaattggaaggaaacatttcagcagaagcaatctgaatgatgcacacgatcatatcattttcttgctcaaaacaacccagtgattcctctttggaattagaataggtctcttcagggggactgacagcatccttgcagtccagaccatacattttctttttccttactttcaacttttcctcttttccctccccctgtcctttcctttcccttcctttcctgtctttcttttcctttcctttccttctaataatacatttaaggggtacaagtacagttttgttacatggatatattgtgtagtcatgaagtatgggctttccatgtaaccatcacatgaatggtgtacattgtacccattaagtaattttctcatctcccaaccccctctacccttccagcctcacatccttccaagtctccaatgtctattattccattctccatgtccgtgtgtacacattattttcaacttcatctattccatattatcttcttaaagtgttttaaaaaattatttttaaattgttaaaatagtatatatagtatatatttatcatatgtaacatgatgttttgaaatacgtatgcatcatggaatggttcaagagagataatttacatatgcatgctctcattttttgtactgagaacattaaaaatctactcagcaattttcaaaaatatgttattaactgtagtcacattgtttgcaatagatctctaagttattcctcctatctaaatgaaaatttgtatcctttcacttacatctaacccaccaccactcccagctccagaccctgttaatcaccgttttactttctacttctataagatcaagtgttttagatttcacatatatgtgatctcttgcagcacacgtctttgtgtgcctggcttctttcactaaacataatgtcctaaaggtacctacatgttgttgtaaatgacagaatttccctctttttaaaaggccagatagtattctattgtgtatatgtaccacattttatttatccattcatctgtcaattgactccgtagtctagccattgtgaataatgctgcaatgaacatgagtgtgcaggtatctctcttcaatttattttttttcctttggatatatttattttcctttggatatatacccagaagtaagatttgctggatcacatggaatttctatttttaatttttggaggaactttatgcagttttctgtaatggctgtgttgtttttgttttttttttttttggtttttggagacagagtcttgctctgttgcccaggatgaagtgcagtggagtgatctcagctcactgcacctctgcataatggctgtaatttatatttccaccaaaagtgtactagggtcctccttttttccacatatctgccagtacttgtcatcttttgtctttttgataacagccattctaacaggtgtgaaatggtatctcattgttcccccccattcttgttccctgatttccaattgcaggtcttatccttctgctccttaagccttcccaggcattcctcttgccttggaacttgctgttccttctacctgggagtcttttctctgatctttacaatatggattctctcttatgtagatcttagctctaatgtcatctcttcagagatacttctggtcaccctgtctacagcagcccctcctttcctctcccttctcaggccatcactctctattcctttgcaataattgattttccttatatcgtatctcactaccaaaaattgttgtttattaattttcttgtatattgctgcttgttttcttatttattgacaggcagtacaaagcagtggttaaggataagaataaactccagagtcagcttgggtttgaatcccatctctatcactatgcaggtgaccatggcaagttacttaatttccctatgtttcaattttatcattaataaaattgggataaaaatagtacctgcctcataggattattgtgagaattaaatgagccaatcagcataaatcacttagaacagtacctgaaacatagtagcactaaataaattgttattattatttgtcttttacattagaataacagtaagaatcttagccctctagttcaaatgctgaattctctagcatctagcatagtgttttgcaatagcagatactcaatcaatacttgaataaatgttttataggagattgcctagaggaggagaagaaattttcaggggactagatctgaaaaagcaatttaagtcacagatgaaaagaaattcgctattacgtaatgaagacgagagatgggaggggttgttagcacaattagctgtaacctggtattaatgaggccaaggtgataggtttggcacttttgtgtgttccacttaggttcgttctctgccatgatcatttgttctgcatttgtatggctagtcagctgtcttatgcatcaatgcccacaatcaggaagagagagaacaaagaaatacatttatcaattatggctaaggaaaatccatctgaaagtgtcttcctgataaacagtggtgattcttggtgttgtcaatatggcatatttcagtactagctctctactgagttcaaaccacctagcacaggtgatctcatactaataatatttccagtgcttaaacaaccccctcctgagatggaagttgggtttgagaaattaggatgagcattcccaatttcttctcccttcctgaaatatttttggttgccaccaggtggtactaggtaagcacatccgaacaggacaatgtagttttattatacaaaagattgccaagagttgcaaaaaaattcctacgtataacttctagaaagattactattgtataagacagaatacacttcacttttggtttagacttttaaaacaatgtttcatactatctaatattcaaattgtgctaaggtttgggagaagactccatcttcctatgatgaacgctttcattttggagtagcttttgtcttaagcaggaattaaaaatcctaagtcatgacaatttcaggtctccagagaaagccttctcattttcccttagaaatttacttggaatttcgtcaggagttttcttcccctccttttcttctttatcttcctcttcctccttttctgctcattctcctcctcctactccctcttcctcttcttcctctctgtcctcttcctcttctttttcttcctcctcccttttcttcttcttcttcctcctcctccccctcctcttctcctttttctctttttccttctccttcttctaatctcctattttccttctctgcttcatagacacgtgcttttgcctgtcttagtttactcatctgagaaatggggctagaaatacatgcctaactaggttctttaaatgtgaaagcatgtatttgagtgagtagtcagtaaaagatagcttgtctttgtcatcatcattctaatggacattttcaactaatccttagggtcaaaattattccagttcattttctttatttgataggattttaactgtctttttatccatttccataattggcaaatgagttcacatgaggcatctactgtatcagcatgcagctatgagaagaagcatcagaaaaaataattgccactgcctgggcacaaatttttccctccctgtcttaacaaactgctttatttctgaccccttaactacagtgtttcttgttcaatgctgagtacatcttgcaaaccaagcttgaaacacagacctgctctctatcctagagagtaaccttctttctttaatctgaaacataaataacctacctcttatttccaggtgaatagctgtctatttctatttgactttctgatcatgtgtccacttttccaagcttatatcctcaatatcccttttacaaagatttaccctgtctttccttttcctctgagtataatactattttaagaactttctgctcagaacttttattatcctgaagactacagccaaattgtcataaggaaacagtgactttgtgaaagaagtatgtacttttcaaagctcaactccttgtccagacacatctggcaacacctacaaatactgtcagctaaggctcctgctgtggtcatagaactacagcattatctcagagagtctgtaaagtcctcttattctggggaagtgggtaagaaagtcgaagtagggatggaataagggaaagagagtgtagataaaagaaattctcctgaagagtatgtcaccttttcaagcatctctaagtgaaattggttcagattcctaatcttacatacaattcaataattaaagaagggttaagataaattcaaatcggcatcacttatgcatttaaagaacacgtacaattttcctttctgctttctcaaccctttttaagtttatttgtttatttttgagacaggatctcactctgtcacccaggctaaagtgcagtggtgcagtcccatctcacagcggccttcacctgccacgctcaagcaatcctctcacctcagtctcccaagtagctgggactacaggcatatgccaccatgtccagttaattttttaaattttcttttgtagagacagagtcttactatgttgcccaggctgatcttgaactcctgggctcaagggatccctcatcccaaagtgctgggatcacaggtgtgagacactgggcccagctcaatctttttatttaatagcccaacttcacaggatttagaaaaaatagtcaccaaatatcctattttagggtagcatgagcattttctttttcctgaactccatatgtttggcttaaggcaatgtggatattttctcattttattttattctcagcaatatagcaagaagtaattcatttattttgttaaatctctaatgtatagcttagctgaagtcaataaaagtcaaagttaccattcacataggctatggtccatttctgacaatctcaaaaccatgccatggcacttaaaaaaacctgctattttatatgtatacttaggtttctcattcaaaactaagcaaacatggaattcaaaggaagttaatcatgtgtgactgcagagtggaaataaaatgaaatttctaatggtaacaaatatataatcagatcattaatgtttattaagggcaaagggacattccaaacactgcggcaaattgtaaagtgctgtaacctctaagagtgagacctgctctgtcatcctcactgagatttctacctaattcgttaaaattcatttttgtttattttaagtatgcatacttgccctctgctaggaacagagggaaatgcgtgaaaaggttaatggggttttgattacttgaatgggcagaggagaattccttgtcaggagcacattgcctgtaggtcaaactggttacaataatgccctatggttttagggcatttagattctccttactaattcttcagaatcctcattttttttttctgcaggtatttttctctgcctgcagatcatgcactctctatgctcaatacattctgacaacacactagtcctgctctaattcacctgagacaaaatggcagcaaatacaaaataaccttccaggctggctcgaaattagcataggctctgtagcccaacggccccagggctgaaaactgtaccctttactagacagataactttgggaaagtcactcaatttttctgaacttcagttttatcatctgtcaaatgggtctaactatcaataatgacaattgctgccaattcccagttcatcaggtagatgtgacagtaatatgagaaaacttttacaaatcatgtagcacatagtcaacagatcagtatttactaatactacttaagtatgtggaggaaatgcttgtcatatttaataatttttagttatttatcttagtcatgagttttgattattgacaacattgctccaaagagttttgttttaattgccttacagatgctgtgttataaaggaggacagttttgtgctggagtgaaggataaacacaggggaaaggcacattttcaaagcagcaatctcttgactagccatatcctgctttttactcacttaaacctctaaatccacagctgcaagcaaccaaaggccacaagtcccaaagaagcaatctaatcaaagaaaacattgaatcaaactggcttctctcccttctcctcaactggcatgaaaaatgctaaaggtggtaataataataatatatttaacatttctcatgttttttgtttctaaaacatatggtttcttgctacatgtagagaattgctaagacattcatttcagctttcagctcttgcaaattaaacatacgttgtgtaaaaactactttaaatgaatgatttttgaaatgaagttttaaaaagtactctttgagagatgaactcccttttttccatatatgtatctggatttctttatgtcttttttgagtagcatcccctcacaagagtagcatcccgaaggaaacttcatagcattaaccatcatggtaatagattaattactaatacaagtatttgtttaaggtctaacttattaactagagggtgagatctctaacagcaggggtcctgcctgttcaccacttcatcatcaaaatctagaaaggagctaggcacatagtagaacctcaaaaaagtttggaaaggcagaacaggttgtggtgaggagacagctgtagagttagaaagtcctagaattgaatctgaataaaaccttacacactctttgcatacttgggcaaaattcttaagttccctaatcagtttcctctttgataaaataaggagaataatacttatgttgcagagctattgtaaaaagagtaaaataataatgtatctaaagcatacagaattatacctgatgcattccaagtgttttataaataattgctattataattatcatgattactgtatagtggatacatgtagaattaattatttaatgtgatgctgaggaccaggccttgactattgagtctttttaaaggcattgtctcccagtttcccatctgcttcacagctccatccatatgcctttttgaaatacacatccagctcctggtcctttttaaacttcgagaaaaagcatcttatgtcatcaaatgtcaatgtaatattaaaggcatttgtatctctgtttaagatcccacatctgttatcagttaatattttgagagattcttactagcagcagtttctgatccatgccataaaaaatgcttttcataaaattgtgtacaaaacccacttatgttttaaaagcccaatgatagctcactaagtatagtgatttcttcaacatgatgttgtcatctgataggtgtgtagggaagcaaagcacatttgcacttgtcctaagaaataaaaagggtccttctgaagttcatttaactcaacttttctattctcctcagttaaaaggttttgccacttgagagtgaaaaattatgaccatagaaattacattttagtaattactcagatttataaaatcatttttcaaataccaaaggtctagtaaaacattaacattcagggatttcactttcccctttatttctaaaatttgcattttatgttatgccttcagcttttctaatgaggattcaaaacatgttcatcatcaaaccattgatgcatctggatgtctacaactttgtagtttaagtccatcccttatacagtagataactattgaagaaaaccaaaactaatgtaatctttgtgaagaaacagggtttttttcagaaatatgagactagagacccaaagatttcaaaatttctgtgggagtgttgatggccgtggccatttcccactcctgaatactaattttgcatgttcccaaactgcaattctttggagtctcttgagtcatcttttagttggtaatattgttgttgcttcctttgctaagtataatctactaaacaatcttggagttctgattacagaccactgcagtatcttttaagtaactctgggaaacatgaagcctaatgttttggttcgttagtattggttagtattcattagtattggttcgttggtattggttagtattcattagtattggttcgttggtatttggttcagcagtattggttaatatgatttcaagtatggaggagagcaccgcccaacaagaatgctgtgtgtgccacacctcccttaccatttgaactaagtgcaacctttcattgtttctttttgcgagtgggtgggggggggcactgagggtgggagggcaactcctatgtaccagacatggaatcaggtgctggagattcagtgataaaccaggaaagatgaatgaaacccaaaaaccaaactagaaaggttagcaaacagttatcaaccaacattctaaaccccaatggctttaaaggtaagtctagggatgttgtactttatttgccatctcttaaaaaaggaattaaaaaatacaagaagaaagaaactctaatggccagtagccataaaatctatttacatattcttccacctctcaagtctcatgcaaattaatgtgtaattacatttagatggcgcagctgctctgacactctgctcccagcttttatttctgagtttcaaaggtttcataaggaaaccttgaaagaaaaaagtaaatattttgaaaaggagttacaatttgtcagcagtaatccttccctggataggcaaagaaaggcaaatcttggtagatgagagaattgtggcttttgaaaataatagcattacactgaaatttaatctgctagcgttattttttccaagcaaaccctctttgcattcaatttgtcatttattacagtaagaagcaacagggtccaaaagagaattgtttgcagtaagcacagagatattctcaacaaaggtagaatttgatagcatgcacaaaacaacacattacttatccagcattctgagtcaccttttcagcaaagaaccttgtgtatttgatagcaaagggagaagaaatcgtgtttattggaatgttaaaatgcgtgatagggcggacattctattttaaagaaatatgagactggaatattgattctgccacatacgaaggctggaaagtattcataaatgatcaattgcctatagtttaatgacggaagataggcattggtttcccaaacctttttatgctacaacaaaaccgcacaccaagccctgccggagggtgctgtataatcatcagagccctttctgagtatgtcaggatgatgcgccctagtgctgaaagatggtggttacatgagcaacagaatgctagttagcaaggcaatgaggagctgaggtccacattaaccatggtcggtgcacctaatcatgaatcacagctgtgccacccttggcagatgaacaatctcttacagataagacaaattttatctgggatcagtatagtcttttaaatgatgtatgaaaccaatttaagaaaggctgagttattccaaatagtatggcttttattctttatttgtcagtttcatcattccctccttgctgactattcagatacatgtaaaggagacagccaatggtttggcacatagttggcacacaatgaatggcagagatccttgtttgtgttagtattttgattatttttcttaccacaataacatgacctgaaccatgatcaatctgtctttatgcttccagtagagatcttgattcatagctctccctaatattaatccatttcatattgttttatattatagttaacatgaattgattttgaatcctttcctctagaagtataacttgtttgagacacttacaagcagacattcaattatattcagagggaaaatttataacagttcaggagaggaatttaactgtcatgtattccaccagcaggtaatgtcagcattttcttatagttaaatggcttcatcaagttactctattgctttaattctaggatgccatcaattttagggcacattatcagttgagtctcaattcttttacactcttgaggaaaacactccatttaaggtatggattaattataaatgatatcctggtttagaaacattctaagataaactgcatttttttaaagttgaaattgatagtaatttgtgagcatgacgtaagtgcacaaaatcttacatgctttatggtctttaatgttgacttaaaactataatatcaaaagagaaaaattaacagagcctaattactctcaatttataaaggacaggtttcattttcaatcactctccagttttctcaggtttcttattcagccgtataatgtcaggcaggatactaaccagattaggctttatcctcatatctttgaaaacataagttccataacaaaattttccctagaggttacttccagtattacagcatctaagtgattcattataagcactgaaaagggtcacatgtattactttattcatttaaatgaaaagaaataaaaaaattctttatttaaaaagaaaaataatggcaggccttggccactcatgcctgtaatcccagcactttgggaggctgaggctggaggactgcttgaacccaggggtttgagaccaacttgggtaacataacaagacccacacaccaccccccagccctgccgccccgtctctactactactactactactactactactactactactaataataataataattagttgggtgtggtggcacatgcctgtcgttccagctactcaggaggctgaggcaggaggacagcttgagacaggaggatgaggatgttgtgagcagtgattgcaccactgcactccagcctgggagacagagcaagaccctggctaaaaaaaaaaaaaagtctggttgtttgttttagaagagtaataatgaagactcataaatgatcacagcctaggaggccctacaaaatggctgcaattattctgctgatgttggacaagctattttttaggatcaattagttaattgtgtgttgctttaattacttacactctttttaaagctttctttgtgtcacagctgagctcaggagaaaaagtaaagcttgcagagcaattctttaagtgtggatgtaaaatatactaatggatttacttgctagctggcacagtgtttaaatagggtcctgctcacgctgagaaaaaatattttatcagcacctgactccaaagagtcaagaatatggagaaactcacatttctctcatgatgggtaatttctgggtatgcaaagctccctgtagcagtcattcagtatggatcacttattgcaattttaaattttttttttttttttttttgagacggagtctcactcttggccaggctggagtgcagtggcgcaatctgggctcactgcaagctccgcctcctgggttcacgccattctcctgcctcagcctcccgagtagccgggactacaggcgccagccaccacgcccggctaattttttgtatttttagtagagacggggtttcaccatgttagccaggatggtctcgatctcctgacctcgtgatccacccacctcggcctcccaaagtgctgggattacaggcgtgagccacagcgcctggcctaaaatttatttttaaactacaagaagggaatggcaaagtattacatgtttcttaacatgcatctagtcaattagcaaagcaagtcaatcgtttaagcttttcattgtgtaaagggggaggttttatacacggcaatttgaatggctatgcctagaacacgtggaagcacagagaaatttcaaagattatgaacaatagaatggcactaaagacacttttacaaatgttgctttatcaagtgggttttgttttcttgtttttcaagaaaaacagtcttccttactttaaatgtttttttcccataattctgtttactattgataagaatttaatttaagcaccaatgggcaattatggttttctcctcaattgattatccaaaatgttcaatgaaaaatgtttgcctgtgggtcctctcacatttttgtttataacctatgactcctgccacttccatacaccctactagtctctgcataaaaatgaggtttattgacgattggccatcacttaatacaggtacttgatgaatgtgtgaaaaataatggatgaaagaataaataaatgagtaaaggaatcaacctctatcttaactcagccacaagtaataaacaatctcgggtcctaatggtctcagtaaaaatctatataaggtctcctaacttcgaattattttcttaaattattatttgtccataggtgtggtcataccttgtggccatgttcctgagacagggtaatcggaatataagtggaagtggcatagtctttttccaaatctagctcatgagaccatcccacactacccccatgcgctttgccttcccttctctgcagcttgattatcaatgcacaaactggcattggagctcatgcattaaagatggtggaacatcagtcagcccaggttcctgaatgatagcatgacacagcgaaccctgctgcaattttggcctacagaaacaaggaataaacagctgtcatgttaaggcactgttatttcaaggtttatttgttagagcagccatttttttcttttaacacacgtcctctgctttcactaagttcccactcaccaaagggttttactcctactattctaatgatgtcctgtgaatcctgacccatgggttagatctcagctcaagtgtggcttctcaaagggaaacttctcttcctccttaatgaagtcatttctcctctatattctcctgggaatcacatgaccctactccttagcacttgtccaggaaatcttcattgccgcaaatgttctctccctcaaggtcattgatgaggtacagatgccagtcacttcaggagctgtgggcatcacccaggaggccagggcagcaatgcaggtgagcacttatgaaatgccccttaggacacccacagataactgaaggagatgactgccaatgcaattcaattgggaatatatgtgtactcaaatattaatacagataaagtcttatttatgtcagcaggcttctaaagttttggaaagttcatgtgacctaggtttgccgaataaaagacttagcaacaatatagtcatctattaaggagctaggaaaaattttacaaaatgtctcagcactgatgttcatttgtgagcccaggtagctcagatgcactgtgcattaattttaactgcatgtgtgttttatgccattggatcttcaaaaggctcttattgattggacatgtggtagaaaacagaggcattgataaaaatggaaacattcagtgccattcaagaaatcaaagaaaggaaccaataacaaagttatatttttattttgttatttaattttatttcgcttttttgccttgagggtgatagttattcaccttctacaagaaaattgccttcactttgattccaactagaacgcctggttgcaatggctcattaagaatgttgcaacttctttccgcccaagtagactctcaattctcctctttgctgaaccctgaggctactcatgagggttacatgagtaacccagcaacacccagctggctggcttttactttttgtcgagtaagcatcattcctgcaaggaagcagtcagcgaccagatttgggcaactcaagtttcccggcttctctttttgtttttcatattttgttctcttgatctcttcctgctcatttcttacaacaaaaactttgctctggaggcatggacttcttaaagaattttagagtattttaatgattaaagtagtatacagtattacgaatcttcaattagtgaagcaaaagttatcattagtccacaagctattttagcattctagcttattatcacttaacgatttcaatgtttccttcctgggatggcaataatggcatgtttcattttaatagaacacatgttttctgttcatagtgctgatttaaatttgtccctccttaattaagtcattctatctaatcagctttggcatattttctcatagtaagtatttacccttttgcctttttgatggagtggaaatataccttagtcattcaacttgataggacacaacctctttaacacaaaatgataccaccccaggaagaaccagggatttttatcatttactttacaccatgcagatgcctcatcttagcaagactttcttactttcgaggatatcttcaaatttatctgtgcaagactggcttcatgggtgtgcaacctgtataacacacagagctccgtgcctagaatgttctgacacttggtttgctgttctgatattgccatcaataaattcttaacaatatttgaataaggaaattatattttcactttaccctaggccctttctgtactcaaatacctatgcaaggcaaagatgtagattcaaatttcatataatgctcattgttcagggaaaataggtgtagtcttgtctctttattcaatttaacattgaggtagaaaatacagcacataaaacttaagtgtacactctgatgcatttgtacatgcacacacacacagttgtaaccaccaatcattttaagatacagacattatcagctgatcatctgtctccctcatccttcttcccactcaatctctgcaccttctatgggtaaatattatgctgatatatcaccaaattttgaacttaatgtaaacggaatcgtaaacaatatagctttttgtgcttttttggcattctatttgtgagatttatccaagatctaacagagatgtatttttttaaagccgtataatattcaattatatgaatatatcacaatttatccattctattgcagtgggtgtctgggttgtttctaatatttggttattgtgaatattaactattgcgaacattcttgcacatatcttttgatagatatatgcactattttcttttgggtatataactaggagtggaattgctagctcagagtatgtacttatgtttaactttagtagacatcagtagtgacctttgaatgcatattataactttttgccaagctgtatccatgccttcatcatgtaagatttattttgtcttcaatacagcacgttggattgcttccaatagctcttttaaacgtcacaaccatttgggatagaacttttctctatttttacagatttttttcaatattgaaatttagaggacttacaaccagaccaagatttcagagtctgaaagaatacattgattctagttctgttactagtttagtttccataaatacagcaaatcagctgtatttattgcaaatatatattaatcagtagtcacagaaagaaagagaaagtttcagcagagctccaatccaaattcctggtacatattaaatgcttaattaatgcttgattctgtgaatatgtattaaactgtgactatcctaccgttagaaacaataagaaaaatactcataataaataatctatgtttttctgagcattttaagttattatttacagttctaggaatagcttaactttggactcagttagaactatcatcccaagggcacaagtatgcttgagtttcagtaataagtcaataaaacctaaatatattgccaaaatcttagaatgagaaatcacttatttaacaacttcatttgaggggcaacaatattcttgagacacattttaaaaagaagtgttaacaaggatatatgggcttctgtagagaccactctagccaaatacacatacgctatacatatgagtaattttcagaaaattcaggtaaggacctgaaatccaaattactgcatgttgcagacacttgtcattccaagagtaaaaatgtacaataacattattctcgcttctaacaattagtccaggaggacatgttttctaaactctccatggagccctccttcaaataattaacactgttagaaaaaaattttacccctgagagttttaacctctagagccactgctagcattagtgctccctctgtttacaattgataatgagaacagagagacataatttaattgggagggtaaaggggaatttggaaaatgatcagggtgatatgcaaatgttcgtttatttggggtgaccattgagtgctgtgtcactgtgttagacatgatgtttagtactttatagactttttgtcttctcccatttattcctcacagcacatttatgagacaggcactgtattgtgccccagaggaaggcagtctcctgtatgcaagtctttagacctcttgcttatctgtaaaagtaggccttgggtctggaacacttccttaccaagagatagagtcctcatgacctgcgctggacttaccaccttgtgtggaataactttccctgttttgttctgctggagcctgtgcatcatgtggcacctggtcaaccccactgttatatctatcctcttccaggaggggatgaggtgcttcttctgcagcacagaaagggcacctataggccaattgttctgcatcagcctccaggagggaccttctggctttgggggactgacatgcagtactgacactgacctggcgctgtcctttctctatctgaggagtaaagtactgacactgatctggcgctgtcctttctctgtgtgaggagtaaagtactgacactgatctggcgctgtcctttctctatgtgaggagtaaagtactgacactgatctggtgctgtcctttctctttgtgaggagtaaaaaacatcgttcctttgggtatatacccagtaatgggatggctgggtcaaatggtatttcaagttcgagatccttgaggaatcgccacactaacttccacaatggatgaactaatttacagtgctaccgacagtgtaaaagtgttcctatttctccacatcctctccagcatctgttgtttcctgactttttaatgatcgccattctaactagtgtgagatggtatctcattgtggttttgatttgcatttctctgatggccagtgatgatgagcattttttcatgtgtctgttggctgcataaatgtcttgagaactatctgttcatatccttcccccactttttgatggggttgtttgattttttcttgtaaatttgtttaagttctttgtagattctggatattagccctttgtcagatcagtagattgtgaaaattttctcccattctataggttgcctgttcattctgatggtagtttcttttgctgtgcagaagctctttagtttaattagatcccatttgtcaattttggcttttgttgccattgcttttggtgttttagtcatgaagtccttgctaatgcctatgtcttgaatggtattgcctaggttttcttctagagtttttatggttttaagtctaatataaatcatgctgctataaagatacatgcacacatatgtttattgcagcactactcacaatagcaaagacttggaaccaacccaaatgtccatcaatgatagactggattaagaaaatgtggcatatatacaccatggaatactatgcagccataaaaaaggaggagttcatgtcctttgcagggacatggatgaagctggaaaccatcattctcagcaaactattgcaagaacaaaaaaccaaacactgcatgctctcactcataggtgggaattgaacaatgagaacacctggacacaggaaggggaacatcacacactggggcctgttgtggggtgggggaagcggggagggatagcattaggagatatacctaatgtaaatgacaagttaatgggtgcagcacaccaacacggcacatgtatacatatgtaacaaacctgcacattgtgcacatgtaccctagaatttaaagtattaaaaaaaagacacctgcatgcatatttttatcacaacacgattcacaattgcaaagataaggaatcaactgatgagtggataaagaaaatgtgatgtgtgtgtgtgtgtgtgtatatatatacatacatatatgtgtgtatatatatatacatacatatatgtgtgtatatatatatacatacatatatgtgtgtatatatatatatacatacatatatgtgtgtatatatatacattacatacatctaccatgggatactacacagccataaaaaagaataaaataatgtcttttgcaacaacttggatggaactggagtctataatcctaagtgaaataactcaggaatggaaaaccaatattgcatgttctcactaagtgggagctaaactatgggtatgaaaaggcatacagagtggtataatggaaatgggagactcaaagaagagagggagggtgagggtggttaaggaaagaaaaattatctattgggtacgaggtaggctactctggtgatgcgtacattaaaatttcagacttcaccacaatacaattcatgcatgtaacaaaaaaccacttgtacccctaaagctactgaaataaaaaaaataaaaatttttttttttaaaaaaagcatcgttccatccagtgcctgattgtgttgtgttttccttggtgactccaatattaaaatcaaataggcagaaatgctgatttctacttctgatataggcaagagatgccacttcctccacagtccctactttgcaaaagaagaaactgagtcaaagagtacttaagtgacttgtccaaggtcacccagtgaataagaggttgagattcaataggccagacctattttattcaaaaaaatgggctttaatccacacttttctccctataagcttttcttatgtaacttaccattccaataaagaaggaatgtggaggattcagatgagattgcagatgcctatgtatcaatgagcttcatgaagctttctgttttagcagtatctgttatagcccaatatgctttaaactgaggcactagtgtggcataaagctaactcaaatctatttattgctacaatcaagaggttgacatgctttgagaacattcaagttaaaagaacaggaggtgaaatataatgaaagagaaggatacagaaagaaaggactgaaaatatgattaaatgtcagagaagaattcagaagtggtgttgtagaactcctaagtgctcacacattttcattaatcataccattgcaggatactatgaattgtgatcatctactgcccatttatttttattttgtttttgagatggactctcgctctctgttgctcaggctggagtgcagtggcatgatctcggctcactgcaagctccgcctcccaggttcacgccattctcctgcctcagcctcccaagtagctgggactacagttgcccgccaccatgcctggctaattttttgtgtttttagtagagacagggtttcaccatgttagccaggaaggtttcgacctcctgacctcataatccactcaccttggcctcccaaaatgctgggattataggcgtgagccaccacacccggcccatcacaggtattttctaagttgtaagatctatttcctcattatccttcacacaataaataactacctttataaaatacctaatgtgtgtgaagtatccttgtacatgctattcataactatatcccatcacccatcataattttataaggtaggtaaaactttaaacttcattttagaaacatgatttggagaaaagagaatgcttatgcactattggtgggaatgtgaattagttcagcccctgtggagagcagttggagatttctcaaagaacgaagagttgaattaccatttgacccaacagtcccattactggatatatacccaaaggaaaacaaataattctatcaaaaagacacatgcaccccaatgtccatcacagctgtctgtaatgttggactggataaagaaaatgtgggatgtatacaccatggaatactatgcagccatacaaaagagcaaaatcttgtcctttgcagcaacatggatgcagctggaggctattattctaagtgaactaatgcagaaacagaaaaccaaatatcacgtgttctcacctattagtggaagctggacactgggtacacttggacataaagatggaaacaataggcactgaggaatacaagaggagagaggcatggagcaggacgggagttgaaaagctacctcttgggtacaatgctcacttcttgggtaacaggttcaatggtactccaaacctcatcaccatgcaatatacctttgtaacaaacttgcacatctacccccagaatccaaaataaaagtagaaaaagaaggaaaagatacctgattctttttaagcaatgtggacaaggccccagagcagtgacagtccagggtctggtgctcagatccgtctcagtctaacgattaaccatgttctttccacttgtttatatggcttctatcttattcctctatgctcaatggatctctatacctctagttataaatcccataatgggcagggtaggtatcctgctggctgtgtcactcaatagaaaacaaagagacagaatctacaagggctactaggcccacgcctcacatttgttggccacaataggaatatatacagaggctcttggcccacagcctgctctcctccattgtcacctctagctcagtcctgcactgtaaagatccttgcatacatatctatgcccaccccaggccacaagtccaagctcagttcacatcctccacaaataacgaatacttggctactctcctgagctgtaaccgtgcacacttttgtgcaattcaccattcagagttggactcaggaaaatgactcatgcaggttctgaaaaattggcttgtgccacccacttgcataacagattctgggatcccaagtacctgcaatgtggaatagaaggctgtgtgtgggctctggacaggcaggtctcaccttggccctgtggggaactgcacagcaggaagagactcagagtgaaccgctcaaagtcacagtgcccatggatcttcaagaggtgtgtattgactggatgattggcagaaaaaaggggcattgcaacaaatgagatcattacaggaatcaaagagcccaaatcatagtttttaaaagatttttccttggagttgctaattattcgtaatctacaaggcaacctcagcttattctactttgattccaactgagaacagccaggttgcaatgcctcattaagaatgttgtgatttcttttctgactgggtagacacacatctctagcttgctgaacctgcatgttaccactagagctctgcctctgaaaggcaaggaattgccctgttcttgcccctgctggctctcactctgtggggagcaggcactgcttctgcagggatgcaaggcaagtaatcacacatccttctaagaaccttatatcagatactatgcccatgatgcaacttcctatctatgtcttatgaatgtcttaaagaattttcataaacttgaatgatacaagtgatatgaggttagagggaagtcagaggtggtggactcacttacatttgctgattaaatacatctcagttttctgttttggtaataaaaattatctaaagttcaactcccgggaagggctgcttctctttttccccttctccgtcccagaatggctccaggtacaggaaaacacctactagtgttgtagatgaaatgagaatgaaacttgcattatgctcatcgctgggttggtttccattgcaaggcatggttgttctaatcctggaatgtgccccagtcggtacttgatgagggctagtgggcaggaatcccttttggctgctgcctctactcactttgaatatacttctattttgtatttcctccactcttcctatttttttttaagagttctctctctttaatgcatgtgcttagttcagtccaatgaaaggggaaaggattgaatctgatgacctgggttcactcctagctttactatttcccagctatagaatattgggagtccctggacttccttgagacttagtttgtttctctgaaatataagggcataatgtttgtcctttatacagcatagatttaaagatcaaaaagctgtagtttttttgtaggtcaaaggggctctgtaaatcgtaaagtgcttgcagaatggtgaagtggaaatacggtgggattaacgtttagatgacccagccttaaatccaggctctgccaatgattggttttagattcctaatatttagaatgactagataactttgactttccttagaggtctaataatccatgaaattaaaatttcaagtattcaaaaataatttaaattcaacctctgagtcaggaaatgaaaactgatctctttagatttcaaggttttaaatatgataaagtatacataagcagaaggaaacattggaaatagatgtttcacttgaaatgggcagcttttttagaaagggaaacatacaggatccctcctcatttaattcatgtgttcaacaaacatttactgagcatctactagtaaggatgtagaaatgttcccgatatagttgggagatataaaaattagtatgtttgggagcctttatatcaagggatttaccattcattaatggagagaagctcaagaataactacaataagtgggactttcaaaattgctaccaatgagagttatttttaaaagttccactgggaggtaagaaaagaaggaatatatttgctctgtggcagacttaactgtgaatttctggaagtttcaacgaaaagctggttcatcaagaatgcacggaggaataagaatatgactgtggagtaaatactgggtcgaacctcattgttctacaattttctgagtgtaattccacaaatgtcctatatttcttagcaaacatccatttaattcttttctgagagcacgttctaagtttgggcatgaatatgtctgtgttgacgtgtatatatatgactttgcctgcatctttatatcttttttcctcttttacaaaaattaatatagaaagttctgtcatgatcccaaggtataacatgacagacgcttcaggaggtgtctggtctagttggtgagataaaagccaagatgataattctttggtgtatgccaaatgccatgcatacatgatcccatttatctttcacaactgtgtaagccaggcactgtgactagacccgttctccagatgaggagcctaagtcttagaaaggctgaataacttctactaagaatgtagcttgtatgtgttgggtttacgcctcaggactatatttaacaaatacttaaaacttaccacgtgctttacaaatactaactcctttgttatatctctctaactagtctatgagtagatgcagtcttatctccattttatagttgaagaaattaaggaacagagactcagcaacttgcctgaggtcacacggttaataagtggtacacagctggtgtttgaagccaggcggtctgtctcccagtccatgctcctaaccactctgagggcagcttctcaaatcccgctagattgggcttcaaagccctatggttaatcactgtacaaatggcctctttgtgctatcacctgaacagaaacaaatataacatccgtgacatcgagagagctgctaatccaaccatctgcattcaggttctgcctctgtgctcagccagcctgcctctgtaaggcactaacacacattctttctaccactgacctgcactttggcattctcatcctgtggctttaattaaatgttaacattcatttgcccttttccattgtgttaaagataacctttgcttcctgtcgcgtctagataagcttcactccatgacaggtaccaaataggttcatcttgatataaagtaaagaatggagactctttgatcctctctgctgacatattttaaaatgccagtatgaatatttgttttgtacttacttcttttacggaatgtcaggataataaattatttctggatactgcagtagctgaaaggttcaagtccaaattagtcatactaagtggctttgacccttcctgagagtcaaacagacttatctctgagacacttttgtttctaatagttgaaaatacattatggagagaggtgctggttgggatttagagggtcacaatttgctggtttggaggaaggttataaagaggttttctggatctttactcatacattcactctattggatgggggatggcttcttgctaaagtgagaagagcattagactgagaatcaggcctagattccagcctcatttttgccacagatgcattatgtgagcttgaacaagtctcttattttctctgaaccccagttgctttattgttttaacaattatatttcattaacagtacataattgaaggatgttatctgatttgctcatcagaataaactcatgagatgcagatttgtattcacattttacagaaaagaaaactgatctttagagaagttaagcaatattcccaaggtcataacacagctagtaaaggaggtggagccagaattcaatcgtggggctatccaatttggaaatccatgctcttcaccattatagctacattcattgttggagagttctacatgtttatgagtgtactcattgtcgctttagagatgctgcatgtatctcctaaaaatgtttttggcagatgatcactgtctttgatagcccattgcagtgatgccatctctaatagcatttactttcctagcctcggaaaattagacacccccctggttagtcagggtggttattggcagcatatataaaattatcttgaattttacagaaagaagagaattctctgtgtttctgaattttggtactaggagaaatattatatttttataagttataatgtattagaaaaaggatattttaaaatgtaagagaaaacaagagttaaagatgagcttggaaaaggagaaatggcagaagagattcctctttggaatgcatcttacaacaactaaatatacacagagtatctatgacaataaaacacttcaaaatattagtaatattttatgtaggtgatgggattatagaatttctcatttcttttttctttttaagctttgctaaattttctgtaatacatatgcattgtttttgtgctaaaaataagtgaaacacacacttatgtacatgtctgcagcaagcaaacaataaaccatctagtagtcttaggctagctaacatcccagacagcaatttgtctatggcacatatctagactaggctaactgcccaggttggtcacatcaaaaaacatatgtccctttgttaatctctctgatgtcatccattatttccaacctaatttcatattagattattagtgcaaggctttcctaaagcaatacacctcttaaatgattacatgacaggaagtcttcagactaagagcctattttaatcagttatttccacttctaaaaattatatttactttctttttcattttcttttttttttctccttttttctttttctttttttttttttttctgagacatagtctggctctattgcccaggctggagtgcactggcatgagctcagctcactgcaacctccacctctgggactcaagccatcctcccatctcagcctcccaaatagctgggactataggtgtacgccaccaggcccacataatttttgtattttttgtagatacggggttgtgccatgttacccaggctggtctcggactcatgagctcaagtgacctgcctgcctcagcctcccaattacagggattacaggtgtgcgccactgcacctggcctatatttactttctagtcattgaaatagatcaagttttttcaatgcaattaatgaaatgcattatcctttatttatgctaattttgtcctccattccatatgtctagaccccttgtactaatttttggctatcccacagtttcgtaattggccttactctttctcatgattcaccagccataggcacaatgtcactagactactctttctaagatacatcaagtgggtcaatgcagtctttgagaatgtatggtatttgccccaatacctataatcccctccaaaatagcagacaaaatagtctcttcataacctggtcctctaagtttggtatcaaatcacatttccttgatcttctaacatgcttcaaccacacctgcctttctgccacatggtcatactttactcagcccctggccttctgctttgattcttatttttttctggtcattgacggtctttttttccccttctgcttattttctttctagtgttatctcttcctaaagccttctgcaattaccgtgcctattgaaattgctctttttcatcagtctttagtaattaaactcttttgtattagtccattttcatactgctgtaaagaactgcccaagattaggtaatttataaaggaaagagatttaatggactcatagttcagcatggctcaggaggcgtcaggaaacttacaatcatggcagaaagcaaaggggtagcaagacaccttcttcacaaggcagcaggaaggagaagagcaagcaggggaaatgccagacacttataaaaccatcagatctcataagaactcactctctataaagagaacagcatgggggaaaccatccccatgttccaattacttccacctggtcccatccttgacactcagggattataaggattatggagattacaattcaagatgagattttgggtgggaacacaacaaaaccatatcatctttactaaatatttattgttgttttttaactaacacataataatttacatatttatagggtacatagtgatgtttctatacacaccatgtatagtgatcagatcagggtaattaacatatccgtcatcttaaaacatttatcattcttttgtgttgggaacactcagtatccttctaactatttgaaactaatatatcattaactatagtcatcctatagtgctataaaacactagaacttattcctcctatctagctgtaattttgtatcctttagcaaatttccccctacccctctttccccaacactcttcccagtctttacaatcctttgttctactttttattctgtgagattaacttattttagcttccatatatgaatgagaactttctgttcctggtttatttcacttaatatgatgcccttcagttccatattgatattctgtcatttagtaagatttcttttattattctctaggtcatatctctatctatctatctatctatttatctatttatctatctatctatcatatctgtatgctgtggctccccaatatggctgttagttgtagaaaggtaggagtgtaatctgtatattgtattttctttttatccctatcagtgtcttgtacagtgttgagaatatagtaggtacttgataaaattttgctaaatcatatttaggttcgtgataactgagtttaatcctccaccaaataaatgagatttcgtcattagtaaatcaaattttaagtacaaagatcatttaatttttaaaaagttcaataattattcacttattttatctgtttttgactataaacagagcattgttcatgctcaaatgcttaactggttgaaagaagctcttcctctgacaacttcctgtcaaacggttatttaaaactctcaagtgtgttgctctaggagaatgacaccacggtgatttaacatgggatgatgcctaaacaatggatgacagaagagttattaacaggaagcaactatattgcagtgtcctcaaagactcctaaataacaggaaagttatcttcactcaactagctgcctggtaaagactgttgcctcattaacaattgttgcctcttttattttactgcctttatttttcttttactatactttgctgctgtggttattaaactgccaaagccagtatggaaggaggagctgtgttttggaacccagtgttctcatctgcattctccctcagcgagattttctgtcatcaaattagcctagagaaatagcatgctgattaaaaataagctttaagttccattgaaagctagaagtctattatttgcctagatccaggcatagaaaggaagacactcaatataaaagaattaccagttacattctgatttccattgtccttttaaagttaaattatttaaaaaatcttatagcagaaaaatggcttgaagtaggttttatctaataacttaggtggataaacaaaaaaaatcaatttgatcattattgcccaatattgcgtcttatgtgcagaactttatattactataaaaatttattttagtattccttccaagtatccactgaaagagctatatgttttccctccttccaccttcagcccatgaagacagatcctattttctcaaataatttcttaatgtttaatgaataattaaactgaatttcaaatatgtaaagagctaaagagatctcatgagagttatggacagaaaccaccatatgtaaaatgcaaaaaaagattaaaatttatcaatggagaatgatcaacactgaaactgatgatgcccacttatatattttttagaatttttagaaattaattgaattttatacttgaaaaataaggatttgtaagcaatattaagcaatagtgaagtttagctctaggtttagaatcagagaaactgaatttgacttctagtgacataatctcttaccaggtgataggttggtcatgtgatatctttttctgattcttaataatgaggataatgtcattcttacttttttcaccaggtgatctttcagaataagactgtgaaagtagtttgtactcataaggtgctctagaaatgtaagttattatttctcccatatctattgctatataaactgtgcactttaaagttttatctatatggaataattctaccctatgagaggggctcccaacccccgggccacagacctgtaccagtgtgtgtcctgttaggaactgggatgcacagcaagaggtgagtgagcattactgcctgagctctaccttctgttggatcagctgtggcattagagtctcataaaagtgcggacccgattgtgagctgcgtatgtgagggatccaggttgcatgctccttatgagaatgcctgatgattgatgatctctgaagtggaacagtttcattccaaaaccatccctccactgtcgcctaggtggaaaaattgtcttccaggaaaccgattggtccctgctgccaaaaagattgggaactgctgccctatgacatctaagaaagcaaagctgtttagaaagaaaacatagtagtttatgctgggcactagctatatgctaggcattgtgcaagcagtatttaacttcatcttcaaaataaccctctgagttagggacacaattatatccggtttacaggtgaagaaatataagcccaaagaggttaaaaacttgcccaaatcagggcataaatagtagagtcagctgcatcctagattttctccaaatgctgtccccttccccaccatattgcattggagatcttttctttcatcacaggatttataaaagcaaaagtccacttcagggaggagccaacccccttgataaagacatgagggggacttgcccatcaacaaagaaggtgccagatgcttccctctcagatggccctggcagcatgcctgttccataaattgcctcagtgaggcttctgctactacatccctttattaaggcctttctgtgattactctgctgctttctttccaatctctcagataaaagagcaaataagcagatgaaaaatgcagtctaaaggctgagttagaaagaaactgcactatgagaagcagggaaagtaactaatattttctaagtcactgtcatgtctctgcttctaagttgtcttaatccattcacaacaatttcctagagctgtattattattaccacttttcacagaatacatttgcactcaaaaagattaggtaatttctcttggaacctggtttgattcaaattgtttccaaagtctccctttgtgttattacaatagaatgcaaaacaaggaatgaagtacagtgtaagttattcattatcaagagggcttcgtcagtcccaaaagggtaaaacattgtttcacggttgtcttcatctgtttggattgctacaatgaatatcacaaactgggtagcttctaaacaacaggaatatatttctcagagtactacaagctaggaagtccaagatgaaggcactggcagatatggcatctggtgagggcccatttcctcaccagacaccttcttgccatatcctcacctagtcgaagggctgagggtctctttaaggaggactgttttataaagtcactaatcccattcatgaggactccaccctcatgacctgatcatctcccaaagtctcgactcttaataccattacagtgggttaggatttcaaaatatacattttggggaaacacattcagaccactgcaatatctaaaaatctttctcttgctatgtgtaaggcatagatatgcatatagcacataaacaaatatacagtatacatggggtattaaaatttcattggagaggtgattaggagaaaacatttgaaaaagctttttaggaggacaaggatgaaaaaaggctaagaaacacaggtgtaaagaaagaaataataactaaagtgaactaaacttgcagggattttggctctcatcaaggtccggacgaggtgcatgctgtttctccactgcgtcagccatgggagatatcatcgtatattttagagcacatgaggcaaagttgggggcacttctcaaaacctggtgaaattccatcgaatccaatcaaagtccagaagaatcagcactatttttctttctttctttcattctttctttatttttattttattgattgattgattgatttttttgagatgggatcttgctctgtcacccagcctggagtgcagtggtgtgatcttggctcactgcaacctctgcctgccaggttcaagcaattctcctgcctcagccttccaagtagctgggattacagacgcacaccaccatgcccagctaatttttgtatttttagtagaaatggggtttcaccaagttggccaggctggtctcgaactcttgacctcaggtgatccacctgccttgccctcccaaagtgctgtgattacaggcgtgagccaccatgcacggccgaaagcactacttctaaactgttaaactcctagaatcaagcaatcctccagcctcagcctcccaaagctttgggattacaggcataaaccaccatacccagcccaagttattttcagttaaagaaacacagagaaatggtttggcccatgtatgggcaaaccaagtctttgctgtgctcctctctccacacacaacgttctaccatcacatcacaacctgcctttcattctttcatccgtctcccaggatggagtcagcccctagattcatgcctcaaaaaatccttgatttctccacctcacattcttcttttgcctcttggaatgtcccatgtctgcacagagtgtcgtacagcccagacactgcatttacaaagacctggatttgaattctgactctgcaatgaatgactgggtgcaattgatatatcctcttcttatgcctcagtttttccttatgtaaaatgggactactgatttttaccttatgagacagtcatgaagagagaacatggaagccatttagcactgtgtctggtcagtagtaagtatttatttgatgttaatataccaggaattttgacaactaagttattctcttcttagatctgaaacaatgtgtatgtgtattacatatcaaacaataaacatgtgtgagccatgaaaaatcataactcagatgacatctccttcaggaaatccacatccatatccctgtctcctctcatctacctctgagctggtatacctttcttttgttgtgttctttaaactgtgttataaatggtccgtttacgttctgtctctttcattaggctgacttccccgtcaaaaaaaattctgccttatgaaatttcctatttttactacctaaaataaaggtttttcataacttactgttaaatgatgaatgttggtgatatgtttccactagtttgattacctgtgttgcatggatgtagcatatattttcatctttgtcagaaagaattttatccctgtatcttaaagctgggacaaaaggccttaccattgaatacaatcttacttctgttgatttaaaacttgactatatatgttaaacctcttaatatagagagaggtatatatgaaatttatcttaaaccataaaaacctacacagtttatacttctttcttatttcaggatgttttctcatttattatcagtctgtttcatataccatgcataattccagggagagacatgcaggaggtaatttctttctatcctttcttgggcttcacagctaattttagcaaatgcatttggcaaactttttgtagaggttcatagtatttattttgcaatttttcattatgagtttcaagagcacaaaacccaaatatcagggagaagaatgcatactgatatcagacatgcagtgttcactagtagcccttatctactgaatcgtaacagcacttaatcttataggtacatattgacagccaatttatctaattactcacattcacaaattaattggagtgataacaggatatattatcctcactctgacatgtttttggaggtcttcagggagacttatttcttgaaacaactgaactcttgaagtcgtttaaaaggatctgatttataatcatggcttagaacgtatcttcattcccttgctgtcctttttttttcaattaatgaagatacttcaattagaaagtcatacagctttgttggaatgacaatgtgaaccttttcatggttaagctcaatagccaatgttacaatctacacttctttgagatttaactaaaagacatattcattgattcaagcaaatgcgtgttcttttcctagtaacactttcttctttatcctttgaaactccatgcaaatgcaaacatcactttctcagaagcctttctggactccttccatatgtgatgaggttggaagcttcttctctgtgttcacctggaactctgtgcatgctgggcacattataccatttcactgtgatcttttatctcttctgttgttaagcaacagatcaaggactgttgcctggcacatcttacaggataggtactaggtcagggaaaagggataaaaatcagaaaaaaggggacctttccttgaggaatcacattttactaggaaatacataaaagtaaactagcaattaaaattaaaggttaaagtctatgaccaagatattctttgttgttgttgttgtttgtttgtttgtttgttttgagacagggtcttgctttgtcccccaggctggagtgtagtggatcctccatggcctactgcagcctcaacctcctagcccaagccatcctcctacttcagcctcccaagtagctgggaccacaggcatgtgccttttttagagatggggtcttgctatgttttccaggctggtcttgaactccaggaatcaagcaatcctccagcctcagcctcccaaagtgttgggattacaggcatgagccaccacgcccagcccaagatattttcacagttcaatgaatgcaaagggcggttgagaaatgactttgcgttggtgcgggtttttacaaggatcaggttttttgggctattagtttgtttgctatgagagataactccatggatatttctgatgtgctattattaaattacacatttaaaaagatagcttaatagcaagcacctgagcagctaatacttttatattctaatgtgtcctcactgtgtacatggccatttgctttcactatatgtaatttttaaaacgtagtttaattcaatatttcctaaacactaactataagtgtgttaattgctgtgaatgacatgaggctgagtaaatttgtcatcttgggaacttattttgagctggaccctgtctacataataggtactatactagtatttgtcctaggccagattatttaattcttgtgaagacacggggaggaagatattatcatttctatttcagagattagaaaattgataatcagaatagttaggtaacttgttcaatgtcacacagctgagaagggggtagaacgagaactaggatcctttcacccaagcctggcttcttgttaaactagtatatggtttcccagaggagtcaccatgctatctagtggtggaagataagacatgaacccaagtggccctgttataagaagactgtcctaaaccctgaataaaccaagaacattgacatttaagatagaaaaatccataaaggcttcatgaagaaggcttcatgcaagaaagtgggaaagatttcccaaagacacggtaaaagggagataggaacatctaacataatctatagtatctatacttctgacaagtttcatactgaaaaataagtaataattactgtactctgaatacctattgtgatttcaattataatcaatattcactgaatgactactatgcatctggtagtgaatgaagctgcattatcttatctacttttcattacgagctacgaagtagatgttattgtatctcattcaatatatgaggaaactgaggtaaaggatttaagtaacttgcccaagcctcacagtaaaataaactgcagagctagcattcaaaacactgtattacttgacctactgttaatatttacgaagtgcttatctctgtgtcagtcccataataagggctcaataataagagttgctaccatttattgcacattattacaaaaggcatgaaagcaagactatgtacaacaatctcaaagaagtctacatggtcgtttttgatgagggattggtgttgggaggagacatgtgggcaaaggcaagttgggagcacaaaagaagaattttcaaggtcagaaagcatttgaccttgatttgagaaacgactatcaaacaacaatggtgttacagcaggccagtaacctgtagaacccaacttataaagtgcgcatttaaaatgcacatttgaaagtgagagatgattgacctagacttggaaagtgattgaacatgagctgcaagggggaaggaagattaaaagatgagttttggggaattgagcttaggtagatgagtgggatatggtggtagattaaattaaatacaaggcaaagagcaataaaatcagccttgggttggggctgggtcaaaggcatggaaggaattaacagaaggaaaatgacaaccctgtttggagaaactttgatttataggagccaatgtggtgtacatctaatgatgttcagcaggttgttaaaaatatgtgtgacttagtatagcccatgagagaaaaggacagggttaattatatagattttgaaatgatacagaactgtgcaatattgctcactaaattattactcattgtgtccaaagtagcttttggtcaccatccccctgtatagtttttttttttaaatttatttatttatttattattattatttttttagacggagtttccctgttgttgcccaggctggagtgcaatggtaggatctcggctacccacaacctccgcctcctgggttcaagtgattctcctgcctcagtctcccgagtagctggaattacaggcacccgccaccatgcctggctaattttgtatttttagtagagacagagtttcaccatgttggccaggttggtctcgaactcctgacctcaggtgacccacccgcctcggccttccaaagtgctgggattacagacatgagccactgcacccagcctgtatagttttatttatttatatttggtgtgctttccagtacctgaaattatgtacaccatatacatttatctttatttttattatcagtattcttcatttcattattataaggaatttatttgacattttcatcactgtatttatagattctagataaaacttggcatattagagggcattcaatgcatacatttcatatgaatgaatgagtatataaatcaatgggtctcagtttttatatccctaatgtaaaacacacattctttatcactaataggccattgatactcctaagaccatgaggaaatctatgcactatctgctcagaaaaaggcacagacactgcaatttctcatatacgtacaaaggattcacagacatctcaaggcccatagattcatctagaatttgagatgcaaagctatgggctcatccagcatttctctcactgtgaaccttgagggaaacctaaacttagggattttgattgtttttataactgatttccaaatatcttagtaaaagtagtgtgatatatatatgtgggagtattaactctggtttctaccctaaagcatgtgggtgtttgaaatacccaaattgggagttcaaattccagagatggctattgcaaatcttgacaatatttttaggacttctagaaatattataaattcgtaaatttaatcaatttataatattgataaatttaattataaattgataaaattcattggttttaaaaactgtggttggcttaaatgaccacaaaagcaacaaaggttgcttttgtgaacaaaatatgcaacccagcaaacccagcagccctgcgttctggaaacaagctctgtggctggggttctgatgggtccatgtatggaagatctctgaaacttagctgtgtgaaaggtaagctgaccctgctgttagaacatgttctgtccaccacagggataaacccttcctgcaaggtgctcgtcaaaaagcctaaatgacagagattggagaccccactgatgtcacagaaagaatggcttgatatgcacatatttgtttgggtgtgtgtgtttgccaaataatgggtggaattattgggtctgatatttgctttcactgtaacataaagagaagaagatttggttaattatatgaatttttgaatgatccaggtttcatgtcctataaagcccaagagcaaagtaagaggtcaaatagccttcaccattcactaatggttaaagcttacaaatccttgccaattatacattctcaaattaacctacattcatttgcaactggttgagagaagaaaggggacacgattaaattgtaaggagacctcagagaaatgggaggagagatagaaaagcaccacaacattgaaaaaacagcaggaaggtttcaagtgggaaggtgtttggtggagttgacaaatgcttcatactttgaaacatataagcactaaggggaaaactttagttttaaaattagagataaaattgattccttttaagaaaaaaaaatcaatagaatggcagtggagtggaaattttcagaaaaagaaatattaaaaacttactgagttcttcttctgtataaaatactgtgtcaggttttgttaggagaacacaatatataagacagattttctgaattttaacaatatttgaattggggatttcttcaactgcaaaaggagatgttatgaaaaatagtgtccaagaataatgaaacacaaagaagttattaattatttgtttggttgctttttcacttattctgttctaatttatttattttatccagtttattcaatctccttttggtaaagtcgtaccaggttctccctttaggtaggtgcttatactccattttcactatatggctagtacagtgactatgtgactatgtgatacataccaccagctctaaccatgggcacaaattgggttgagacaattgatataatgcttcactgataataattgattaagggatgaacctatggctaaattcagggcaataagaacgaggttcaggaattctattagatacctaaggaatagaagttctcacacaccggggcctgttatggggtcaggagacgggggagggatagcgttaggagatatacctaatgtaaatgatgagttaatgggtgcagcacaccaacatggcacatgtatacatatgtaacaaacctgcacgttgtgcaaatgtaccctaaaacttaaagtataataataaataataataataataataaagaagttctctttttttacagttgataggaggaatttaggttcaaaactaaaccttttttgtgctacttgaggctgagcctagaattcccagaggttctcagtctgaaacacagaatcaaagaagaggggaaacaggaattaggtgacattattttagctgctgaattaagcttcacctgaagcttcacttttagtttctaaaagtttagaaatgtctttaaacttttcagctatgtgagttaatatattctcattgttattgaaaccagtttgatttgaattttttaaacttgacattaaaaaaaagtcctaatggagaaatgtctttcagagattctggaaaagccaaggtagggatgaaagtttatgaaggcaaacaatgggctaaatctagaaaaataggttggaaccagcaataaagagccctccaagcctccaaggtatttaaattagctacagattgggcttttaaataattcatcgttcattcctctgtgctcttaacacctgctccttaggcctccagtggttactgatgttgcccagtcatggattacagctcattgttcaaatgtttcttttatccactagattgaatgaaaactcctccagtttttttgagggcaggggttattttttactcaaactactaacctcacatctcctagcataatgcctgttacatagtaagtagttgtagcagggaggaatgaagtgagaacatgtattaatccgttttcatactgctataaataactgcctgagatggggtaatttataaaaggaaagaggtttaatcgattcacagttcagcatgcctggggaggcctcaggaaacttacaatcatggtggaaggggaaggggaagcaaggcaccttcttcacaaagcagtaggagggacaagtgcctagcaaagaggggagagccccttataaaactatcagatcttgtgagaactcactcactatcatgagaacagcacaggggaaccgcacccatgattcaattacctccacctggtctctcccttgacatgtggagattatagggattgcaattcaagatgatattcgggtggggacacaaagcctaaccatatcagagcatcattttggcaactccactctggcagcagtggattgaaaggctggaatgaaataaaaaggaatgagaagagaaggtatgcatttcagtatttcagagagaatggaaaagggctcagagaaataactcaagaaaatgctacaatctgaatctaggcagccccatgaataaaatggagatggccacacgaataagttttcatacagtgatcctttttcctgttcctgttcttttttattcatgtaaagttctgaaaactgttgcccatggtaacattcagtggaaagctgaccagtatttagacacatctatcagatcaaacgttgatgaaaaagccctgtatctttcttttttctagagtcagttctaaatatagacaggatgggctccttagagcaatagaagtgactaacattgagttgcagtattgacaatgtccttttctcccctaaatacaagcaaatttgaaataaaaaataggataaccccaaagagataagtgttttaagcatgccagatattttccagtttttgttgtattttagagtgttgatctcgcactttctgccatgagagcaggatgttcagtaaaaagaggaattagcaatcaaaggaagcactggtcttaaagaagctttaatgcatttgagtaagagatattactttctagagtaaactttagaaataggtccagtatacattgtcatagctgattgagaaaattttctaaagactcagtcttagaaggcagcacatacctcaccctatttataaaatttctttcaattttataaatgttaaggtaatatcctattacttcagaacacttggaaaatacagagaaaaaaacacaaggtgttttactcatgatgtaatctgttcatgcaactactgttaacatgtttttaaatttttttctttagaatattatttacttaaacacaactaagtaaaattttttacactctgtgtctttgcttagataagtcttccctgactttcaatttgtaattttatcccttccctgtccccactattctttttccctagcatgtttgtttttgctttgtagaacttaacacaatttttaacagtggttgtacattttttatgccagtttttcacataaggacagaatcacagttgtgttttgcaatattgcctacccaacaggaggcaagttgttggcatatagcatgcacagaaggtagacgactaaagttttcaggcattgtggtgcagtggtttaaagcagcaggctctgcagcctggcttcctggatttgaaccctttgagaaaggcagaatactggcctcccaaagatgtccacatcctaattcccagagcctctaaatatgttaccttacataatacaaataactttgtgagtgtgactaagttaactatctcaagatgaggaaatcttcttaggatatctgatgggtccagacaaatcacaggggtccttataagtgggaggcaagtggggcagggtcagaaaaaggtgatataatcctggaagcagagagagagcaagatactggaaggggccatgctgctgactttgaagatagaggataaggccacaagccaaggaatgtaggtgactgctaagaatctggaaaagataaggacaaagattctaccctggagtctccataagaaaccagccctgctagcttattttagacttctgacctccagaactgtaacagaataaatctgtgttgtttaaggcactatgcatgtggtcatttgttccagcagcaataggaaattaatatgcctgctttgcatatgaatcgtctcagcagttcaatcattctctctgtgcatcagtttcctcatctgtaaaatgaagaagaaagtggcacctgcctcacagcatagtttaagtccataaatactgcaaagcatgtagaacagtgcttggtatgtcccatgttatcaataaatattaattgctgttgaaagtatatattatcaaacaaacaaaatgacagtcagttactcctttctaattctttaatttaccaatgcaatctatcggtgttaaatttctcaatctttcttacttagttgatgaatagggtgtgtgtgagtgtgtgtgtgtgtctttcttggtatcacagtttttaatttgactgtttagttcatctgctgggaggaggaagagcccttagtcatctttgttctgtggttcacctttagccgcccactccttgcccacattggaggtcacggttgaccctataccagctcctaaggccacctgcttatcagccgaggaatcttctctagtcaacctcacattctttgcatttgggaggaagaaaaaggtgattgcttttattggcctacatctggattccctctttctctctgccttgcttttcagttacctcatcctcagttttaagaatctgcccagcccttcaagatgatgctttgtgttgtccccgtctccatcagtttgggttgccgtaacaaaaatatcacagaatcggcagtttaaacaatagaaatttatttctcacacttctggggactgggaagcccaaagccaaggtgctggaaaattctgtgtctggtgagggcctgcttcctgtcttgtagacagccatcttcttgcagagaggaagagagagcaatcctgtgtttcttcttttttaaataagggcttcaatcccatcctgagggccccaccctcatgacctaattaaattacctaagccaacttacctccccaaagcctcatctcccaatgccattacattagagactacagtttcaccctatgagtttgggttggacacaaacattccacccataacagtccccttcactctacagatattcccccatggttctacttacaatttttcaactgttttttttttttttttttttttttttcagatggagtcttgctctgtcacccaggctggagtgcaatggtgccatctcagctcactgcagcctccacctcctgggttcaagcaattctcctgcctcagcctcccaagtagctgggattatagatgcgcaccaccatgcctggctaatttttgtatttttagtagagacggggtttcaccatgttggccaggctgctcttgaacttctgacctcaaatgatccaccctccttggcctaccaaagtgctgagattacaggcatgagccaccacacctggccccaatttttcaactttacgatgatgcaaaaccatcacaattttgaggtaatgtacagtattcaataaattacatgaagtattcaacaccttattataaaatagaccttgtgttacatcatcttgctctagtgtgggctactgtaagtgttctgagcatgtttaaggtaggctatgttaagctatgatatctggtaagcaaagtgcattaaatgcatttttgactaatgatattttcaattcacaacaggttttttggggcataaccctattgtaaattgaggagcatctgtatttaacacctccagaggttactgatgccctgatcctttatccacctcaggtattcaggttttcatattagtgtcctgattttcatttttaccaggacagtagtcctcaggccagtataatacaaacataaaaaggaagatcctttcaacctaaattttgttaaactcaggggtttagagattgtcttgtgtttgaatttgggctccacaactcttttatccacagggagaatgacgatataccccatattacctaagacaatcccaatttataactatggatccatagttatggatcaatatagttgtgattataactattgtaattattaatggcatcccctgttactcttagaagtatcctggtttttataataaattctataatcgctggatttttgatgttgaatgagtccctttattcctcatctgtaaattacaatgatgacactcctcttataggatgctgggtgcagtaacatgagcaataatcatggtgcatagcagatgctcaatctaggttagattcattgcttttaaataatgactgagctccctaaaaccaagaagaaaaatggagccagactggggaaaactgaataatttgatttggaagaaggtatttaaaagcagtatttagttggagacaagataggcttagtcaacttgccaacggcttaatgccaggaaggcccagtagggtcacagaatctcagaaatggatgaaaccatacttattatcaagtctcttccccctgctcatgcaaaaagcttcaacaatctgtgacaaagccatcacctaattattaatattaatggctaacatttataggacatggtgctaagcaccccaggtggattaccttaaatcttcttcattcgaactctataaggcagatactgtgattgcctcactgtagagatgaagagactgatctatggttgcatgagatttgcaagttcatgtagttagaattcagtatcttcattttgggtggctgaggcaaagggattgtttgagggcaggaagtcgaggccagcctgggcagcatagggggagggagggggggagggagggagggagggagggagggcgggagacagagagagagagaaagggagaaagagaagagaggaaagaaagggaagggaaggaagggaaggaagagaaggaagagaaggaaggaaggaaggaaggaaggaaggaaataattcggtgtcctgcctactagtgagcttttggttgccacataggattttgatgatacaattatgaacgtgaaatttgtatttgaggagttcaaaatgcccttaaaaagtctaaataattgacaagagtttctttattgtaaaggatgctttatttttatggattttatttggcaaatgttacttcctatttgctactagttttttaagcacaatgaaatgctataatatcttgaaacatagggaggacttctgtagttaagaggcaatgatgaaaatgacacattggatactttttccacaacaatctactggtttcagggcctgggagaatgtgttatctattgagaaatttacaatgcaatgaatggatagttaacagaagcactgaggtgtagtgaaaattgttcagggtttcacagacaaaacaacttaattcaacttgatgtgaaatagctgactgtgtgaatttgaaccagtaattttttttttactctgcaccttaggtaccctttctgtaaaatggaagatgggctagattattaacaccttttcaagtttgaccagcctctgattctctgaaatacagcctagattccttgcaaattgtcagtttggcaacaaacggtggtgcttagaaaaagctcagggcattcagtagaattcaattttatatgtcacagatggaagctaattgaaattatgtaggtagatcaagtgtaacaacaaatgcttgcaccagcatgtagcagacctttagcccagaactgcttcagtctgtcaacagcactgagcatgttgcagtaaagttggtaatcatctgtctttcttacagaaagtcattgctgagagcagagttttgttgggtcaaggacaccaggttgcttattttgaaaggaatcatgctcagaatctcgcaaaccaaaagcacttttccaattctgcattaatagatgtttaacttggcccagagcaggagcaacagtgccaaaagggaagcatgcccactaacaagactggactgtggcctgagactttgaagacttctagttttaacttccccctgtctgtatcttgagtgcctgcacctccaagagtttttttgaagcatgcaaatggtctgcctgctctagctccacttcatggctcttctctcttttgtggcatctaatgaggattacctcttgctgcttttgcctgcttgtgtctgttcatttatcttaagttccaggactgtgacttctgcccaagtggtcagcctaaaactgctctctccgcagttaaaaaacaaaacaaaacaaaacaaaaagcaaaaaaccaactagttatcaaaatcaattccattctagttatttattgattgcatgtagtatgctctacactatgcttgaagctgggggttcagaaaggattcagatatatcccttccttttccacatagagctgacatactcctggaggagcggacagatcaactatcctttatgtcaggagatgtactagttttatagaacagagcttctcaaactatatgtagtgaaggatcagttttgttccttattttttttctgtccaattcattgtacagtgatacttttgtaaaataaaaaataacacttatgtgtactgcaacaatatcacattgctgcgattgcttctaaatgcttacattcaatttctgcattttgttgttgtgaatgagtaggcgacaatttgcaaaacagcctgatgtgatttggctctgtgtcaccacccaaatctcatcttgaattttaacccccagtgttggagaaggggcctagtgggaggtcattgaatcatgtgggtggacttcctccttactgttctcatgatagtgagtgagttcttacaagatctgatggtttaaaaatgtgtggcacttcccctgttgctatctctctcctgctctgccacggtaaaacatgattgcttccccttcaccttctgccatgattgtaagtttcctgaggcctccagtcatgcttcctgttaaacctgcagaactgtgagtcaatgaaacctctcttcttcataaactacccagtctcaggtagttctttatagcagtgtgagaatggactaatacacagccccatcctgcagtcaaccactcaaggcagcacttgactgaaacagcttaaataaaatgctgttgaaacacacatgagtacacagttcatcccctctggggtatgagctctatctcagggagaaacaccagggaatatcttttagttctcttcttccttcatctttgcttcattcaaggccaacaactacctccatcttccagtccggttttactttgcttcgatcagattgcactaaacctagtgttctcctcccttccatataacacttttgttcttttgttaatatcattttctccttccgcttatccaatcacactggttcctcagcctggtgctgtccttacactctacactgactccttcagacttcttccaagcccgttgtgatcaggtgaagctcttcacacaaaggcagatagctctgaacacaccattactctgttacactcctggaatgtctgtgcacggtcactcaaggcctctttgatctaattctcacctaaattttcagttgttcttcaccacaatgattgaatccatttgcaatgctgcactgaagctgcattatttgctgttttccacatggatcctggacctacataccttcatgactataatcatgctttttgccccttctgccttaaaacttaccccacatcatcatcatttcccagtgccctgacttgccccactcatccgtcttcacaaataatgcctattccttaatacccagcttcaatgccacatctatcgggaaatattctctagagatcattccacatttgtaataatagctcaatctgctaattcccaatgtatttcattttgcttgttttctggcactaggtagggattgtctgtcttcagctatggtgatttgtaggcacatcacttatcatccatgtaggctctctgaggtcagaattcatgcattacttactctctgtaagtgtctcacacagtgccctgttaatttgattatttattcatttgcaaacacagacgtttttgaacctataatgtgctgttcacatcttaccaaccttataagaacttatcatctattgggagaaatcggataacaaacatagttatcaagctatttggcaagtgcaaagagtgttttgcactgcataatacagaagatggagagaggatgcacagccagcaatgcagatgaccatgtgttcagggagtgtttctttagaaggcatcattggaggcgagagtaaaaagatgagcaagcccaagataggcacctcatagctacctgattgctattctatttgatttgattcctttgcacagttctgagagtcccactcagatttcctctctgagtcttcttcgcatacttacaggcagctgtaatctacttgttgtatacagtttacagtccatttaaccaaccagaatttcaaataaagcagtataagcaactgtattgggttaaatagtgtccacccaacattcatatctacctggaagtcagaatgtaatcttatttggaaatagggtgtttgcagatgaaattaattaagatgacctcatcgtagatgaaggtggtcaaatccaatggctggtgtccttataaggggagggagatttgaggatagagagacacacatgcaataggaatacagcctttggaagacagaggcggaaactggagggatgcagctatcagccaagaaatgccaaggactgccagaaactcccagaagctgagaatccaaggaagaattctctcctggagcctttgtagagttcattcccctgcttgtgctttccaggtttgttctcagacttgcagcctccagaactatgggaggataattattatttttaaatttaatttaagttccaggaaacatgtgcaggatgtgcaggtttgttacataggtaaacgtgtgcaagagtggtttgctgaacctatcaacccatcacctaggagttaagtcccgcgtgcattagctatttatcctaatgctctgcctctccctaatcccctgacaggagagtcaggggagtgggggaagggagcatgttgttcccctccttgtgtccatgtgttcctattgttcagctcccacttataagtgacaacatatggtgtttggtttttctgttcctgcattactttgctgagcataatggcctccagctccatccatgtccctgcaaaggacatctcattcctttttatggctgcatagtattccatgctgtatatgtaccacattttctttacccagtctatcatctatggacatttggcttgattccatgtctttgctattgtgactagtgctgcaatgaacatacaggtgaatgtatctttataatagaatgatttatattcctttggttatatacccagtaataggatttctggatcaaatggtatttctggttataggtctttgaggaatcgccacattgtcttccaaatggttgaactaatttacatttccaccaacagtgtaaaagcgttcctattggggaataaatttatatggtcttacgccacccaatttctgggaatttgttacagcagtcctaggaaactaatatagcagcctcaagagataatgcatgtacatcctcattcttaatttggcctgactatcatagaaatgtcttctcctttattgtcctagatggcttaatttctacagagcgctctgctgattttgcacaaattggaggcatgccaaaattctcttaaagggctatgaatttattcttattttcttaatgcaaaaaaattaagtaaataactatcatttaagttaaaaatattgttttatcacattttccaagtattaaaacttttacattctttgtatctatgtatgttcctcgcacaaagttgttccaggttcagtatacattttgtcaaattgtacccaaggtgctatttcccaaatcatattgcttaactgaatgagtagcgttacttttttatggaaaatatccaagtttgtgaatatgtacagtaaacatttttattaaaatacattgtaaagatgaaagttctaatatttcttaaaactgtgccttggtattgggttggctcttttgtaaaaaaagaaattgaaattactccttttctggtagtagtaggagaccattgggttcttctcagtaggcttatcatatacatttacaggaatatttgaaatgataaaaactctgtttagaaatttctgcctattcttgaaaacatcactgtagcattcatttcatttgataaagatgtgaagccatttgtcaggaggcaagagagagggcggcaaggaacttgaaattgcaataacattaataatttgtggaagctttggtctatttattgttaatgttcaaaccttgtgcacagatgcctgactttcccaatctgtggtcaatgtcaagacatagataagtgcatgcactcaatcagaggaagaaaggaagctggccgatagacaagggcacacataaagtatatgaacaggttaataatgctttctttaatcagctggaattaactgttctttaccccgatgcttgtatttgacaggcggccttgattcaccactgccgataaattgctgggtagaatgaatgcctcagtgctcaggccctgtcatgtgttggagacaaatgtttttgttcatttccctggtaagcacaggtacaaattccttaacaaaggctttaactttaatggtgtaaagtatctgtgtcactctgaaaaaggtgttgtgcacacagaagagaaatgtaatcgatttgttgagttaaaaaaataaacatatatcatgctttaattaagacaaaacattttaatctacctataaaatagttctttatcaatgaccatattgccatggactttatcattgactatacagataaaaagaaggaattcaataaaagaaattgttcaataattgttaaaatgattggctactgggactatgtctaaaataggcaaaatatgtccaaatttaagaatgatttttacatataattcaataattttaatgtatatcaattatgaacaaaatataacttattcaacaaattattattgagaatttactatgtattagaacacttccatagatctgggatttaattcattgctgatgaaattatagaagaatttatttcattcatttattcatatgttcactcagaagcattcttagagcacagaccctgtgcaaagcgttaagagttattcttgccttcgaagaaatttcccagtctagtacagaagatggataagaaagtaattagctaaaatgcaatatgatgtatatgtatatgaggtgcaatatgatatctgtgtacagaagtatcatatatgagatttggtgataacagcacagggacagcagagagaatgaggggattaccgaatgtaggtctgagtgaaaggaccaagggaggtggagaggttcactgagggggcaacacttaatctggaatttgaaggatgatgaaaactttactaaaagaacatcagagacaagaagcattccagtgagagggacaatatgtgcaataaaagagaaacaggaagcaggaaaacgggtcacttgctaggttgatattactgatagtaaggtgttagccaaactggcctgaaatgcaaagaacagagaaataagcaaagatcaagtaagacaaagattgggaaatgtccactgagtttgggatttaagttgtcactgatgacatgtgaaaaagctctttcagtggggtggaaggaactgaagccagaatgtagtgggtggtgagattgtatgtccaaggggggaggcccaacccacatcacctgaacacaaacgatgtctactaaatacttcctcactgtttaacagatacatccatagtattttaatgtaaatacaagaaagaagataatacgaggcattaagaagcaagggtcatagtttgggggagatttctgagtatatttatagaattgttgccagggaaaaggtagagggtgaggattcagaagagagagaggctgaggctcaaggaccagagcccaggagaggtggttaaaaaaccaaagaacaaagatattaaaaatgctggtagaaagataaggcttgaagcagaaagaacacatttctttctcagtctgttcatcaagaaacatttataggacattttctatgacctggggactgtaagatttcttagagacattcataaatcctacctcttgtcactatgcttctaccttaatccactgaccttcaaaatatttttattacattaaaacattattatatataatatagtatataatataattattatatattatataatatatattacactatatagtcaatatgactttgagatatccataactaatatatatcacatataactaatatatattatatattatgtaattatattatataaatattacatataacatatataacatatattatataacatatataacatataacatgtataatatataacatatataacatatattatatataacatatataacatatataacacataacatatataacataacataacatataacgtatattatatataacatatataacgtatattatatataacatatataacgtatattatatataacatatataacgtatattatatataacatatataacgtatattatatataacatatataacgtatattatatataacatatataacatatatataacatatattatatataacatatataacatatattatatataacatatattatatataacatatataacatatatataacatatataaattatatataacatacattatatataacatatataatatataacatacatcatacataacatatataatatattatataacatatactatatatattacatataacgtatataatatatattacatataacgtatataatatatagtacatataacgtatataatatatattacatataacgtatataatatatattacatataacgtatataatatatattacatataacgtatataatatatattacatataacgtatataatatatattacatataacgtatataatatatattacatataacataagaatatatatatgttatatatatattttagtcagaccctcactgtcacccaggctggagtacagtggtgcaatctcagctcaccacaacctctgcctcctgggttcaagagattctcctgcctcagcctcctgagtagctgagattacaggtgcccgctaccatgcccagctaatttttgtatttttagtagaaacagggttttatcatgttgtccaggctggattcaaactccagacctcaagtgatccacccgcctcggcctcccaaagtgttgggattataggcatacgccaccacttctggccatatttttttaacgtataaaataaaacatataaggttaaaaagaaaaccaattatactacaaagcagttatcaaaatattaaaaatacacatgtagatcaggtcttataactactataacataaaagtagtcaatataatgactatttgagaaatccgtaactaaacatatttcagtgtctattggctatgaagtcacaggtgctactaataatactgtggtttgttctctacattcacaattaaatgatatgctaaatttctgttgaggttaatgaaaataaagatggcatgctctttgcacttaggtttacagacccctgaatgctctgatccacctacccaggataaggctcctgtgctgatgggagcttgagaactggctcctggctctctctctctacctcagttcctccactcttatgctcacacacctcattctagttacctcagccttcttcccttttgtcaaacatttggcgagtgcttctgcttcagggattttgcatctactaggctttcttgtgtctacaatgttctccccagatatccatgacttgcttcttcattgtgttcaagtcctcatcaaacgtccctcctcagagatgccaacttgactggcttatagtatgacccactccgtccttctctactcatttaccatgctatatttctcttgacaacactcatttacctaacagcgtatcataaactgtcagcttatttggttagtgactcccctactaggatgtaacttctatgaggcaaggatttctttggcttaacaatatcacagtgactgtcacatagcaagggctcagttattatttgttgaaatagatcatttcaactggctatggaaagtgcttacatgtgaggcatatccattatcctggggcctcagagaggaggaagtactgcttctaggagaaggcattgcctaggtacagtcttgagatcattagagattcaaggaaaggagaaaattgaacatatcagttggaaatatgtataggttctgacctagataaggtctaaagtcatgcttaataaaaataaatggccttgctgggcacggtggctcatgcctgtaatctcatcagtttgggaggctgaggcaggcagatcgcttgagttcaggagttggagaccagcctaggcaacatggtaaaatcctgcctctacaagaagatacaaaaataaaaataataaaaaatggctttatcagtcatactttaatggtcttaattttgcattttatccctactccctaaacttttttctttaaagatcttataagaagcaacccaaaataggcatatataaataatatagatggcaatgtgaatttcacataagcatttaggaagatgagttccattaacaaagaactggactggtgacatttgtataacattgtattgatacaaccactttacttttcataatgtcaatttcatttatttttccactaaaacatattacaaccattcaaatgaatgaatggaaatgcaacttttgagtgactccactgatttttcccccattcaaatggtttttggattcttatattaagcagtcttgagataagcttcattttatgctgatttagagagtgtttcaagatgaaatgtcagcaagccttatctgcaaacaccagatccaataagctatatctggtactaaaaatcagaaattgacacaattttaattagcctccagttagtgaacagatatttaataaatggtcacttcagcttaccttttaagatatacattcaggccgggcgcggtggctcatgtctgttatcccagcactttgggaggctgaggtgggtggatcacaaggtcaggagctcaagaccagcctgaccaagatggtgaaaccccacctctactaaaaaaaaaaaaaaataccaaaaaattagcaggtgcctgtaatgccaattactcgggaggctgaggcagagaattgcttgaacctgggaggcagaggttacagtgagccgagatcgtgccactgcactccagcctgggtgacagagggagactccatcatggaaaaaaaaaaaaaagatatacattcaacgggtacaaattattctctaaattacagccctttgtccttcaagagcatattataaaaccacagaaatgaacataaacagagaaaatacctgaagatatataacaaacggttaatcagtaaataattaattacgtactttcattctttgattctacaaagattacttgatgccagaacaatgctgggtgatgtgctaaggtgctggagatataaacgaaacaagttagacaaggtgcttgtctcatggagcttattttataacgagggagatgaataatgaacaaacacatatataaacgagttcaggcacttacaagtgctataaatacaatcaaataggtaataacataataatgtaattttggtccacatagatctccagtctcttagcgtaaagacaacttaatttaattcctggtcctatcaagccctcacacattaaaagtagctgcctgttaaagaagaaaagagagaagaatcaaatacacgcaataaaaaatgataacggggatatcaccaccaaccccacagaaatagaaactaccatcagagaatactataaacacctctatgcaaataaactagaaaatctagaagaaatggataaattcctcgacacatacaccctcccaagacaaaaccaggaaaaagttgaatctctgaatagaccaataacaggctctgaaattgaggcaataattaatagcttaccaaccaaaaaagtccaggaccagatggattcacagccgaattctaccagaggtacaaggaggagctgttatcattccttctgaaactattccaatcaatagaaaaagagggaatcctccctaattcattttatgaggccagtatcatcctgataccaaagcctggcagagatacaacaaaaaaatagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattacctcaatagatgcagaaaaggcctttgataaaattcaacaaggcttcatgctaaaaactctcaataaattaggtattgatgggatgtatctcaaaataataagagctatttatgacaaacccacagccaatatcatactgaatgggcaaaaactggaagcattccctttgaaaactggcacaagacagggatgccctctctcaccactcctattcaacataatgttggaagtgctggccagggcaatcaggcaggagaaggaaataaagggtattcaattaggaaaagaggaagtcaaattgtccctgtttgcagatgacatgattgtatatctagaaaacctcatcgtctcagctcaaaatctccttaagctgataagcaacttcagcaaagtctcaggatacaaaatcaatgtgcaaaaatcacaagcattcttatacaccaataacagacaaacagagccaaatcatgagtgaactcccattcacaattgcttcaaagagaataaaatacctaggaatccaacttacaagggatgtgaagaacctcttcaaggagaactacaaaccactgctcaatgaaataaaagaggatacaaacaaatggaagaacattccatgctcatgggtaggaagaatcaatatcatgaaaatggctatactgcccaaggtaatttataaattcaatgccatccccatcaagctaccaatgactttcttcacagaattggaaaaaaactaaagttcatatggaaccaaaacagagcccacattgctgagtcaatcctaagccaaaagaacaaagctggaggcatcacgctacttgacttcaaactatactacaaggctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaacaaatggtgctgggaaaactggctagccataggtagaaagctgaaactggatcccttccttacaccttatacaaaaattaattcaagatggattaaagacttacatgttggagctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacttactcatctgacaaagggctaatatccagaatctacaatgaactcaagcgaatttacaagaaaaaaacaaacaaccccatcaaaaagtggggaaggatataaacaaacacttctcaaaagaagacatttatgcagccaacagacacatgaaaaaatgctcatcatcactgaccatcagataaatgcaaatcaaaccacaatgagataccatctcacagtagttagaagggcaatcattaaaaagtcaggaaacaacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggactataaatcgtgctgctataaagacacatgcacatgtatgtttattgcagcactattcacaatagcaaagacttggaaccaacccaaatgtccaacaatgatagattggattaagcaaatgtggcacatatacaccatggaatactatgcagccataaaaaatgatgagttcatgtcctttgtagggacatggatgaagctggaaaccatcattcttggcaaactatcgcaaagacaaaaaaccaaacaccgcatgttctcactcataggtgggaactgaacaatgagaacacatggacacaggaagaggaacatcacacactggggactgttgtggggtggggggaggggggagggatagcattaggagatatacctaatgctaaatgacgagtcaatgggtgcagcacaccaacatggcacatgtatacatatgtaacaaaacctgcacattgtgcacatgtaccctaaaacttaaagtataataataataaaatgaaaaaatttaaaaagtagctgcctgtagaagacaggaggattcctgcattcttttaaacatgctagccatctgcagcagataacagaccccatgtagcaaaaattcctttttgaaatccagtctcatcagcaagttactcaggcaaataattttttcaccagcaattttcccatcccctttagtctgttgatgttgctttctcgtcctgagctttgagtcctgttgatttttcttaagaaatcctagatagggtacaatttattagagaaggcttcctggcttccatgtaacagtgtggaaactgatggcagattgaactggagaacatggaaaaattacctcctaatagtgcagccaactcaaaagtaccttccccagcatttctgaagacaatgcaaaaatatgatgccttataggcagccatgcctcagaacattattgaaacacttgtttcttaaaaatttacatttgctttaatgttgaagtttttcttctcaaagtctactgtaaaaaattaatgagatgcagtcagatggttatccataaaaatgttcatttcattgtaatttataacacaaaaaagtgcaaaataagaaccaaattaggccaaaataaggaactagttagataaattaatatatatccttattttgagtgcttatatactggcatactacagagtcactacatgttttgttgctaaagaatatttaatgacatggaattttgttgatggtagagtttggtaaaaagacaaaaaaaaaggaaaaagaattttctatatagtatgtacagtgtaattcaaattgtatgtttgttcacagaaaaattagtgagcagatatataatcaaaaattaatagtggtcaattgggtaacttacaaagcaacaataacctttttgaggcatttctcaagacttaaaaattttttttctaaagtttatatgggttttctttgcaatcagttaaagatgttattttgaaatgcttcttcttttgagtggtgaacacttcttgaagaggaaatgggttcattctttgacattcacagaggggttagaatcaagtcagaggctaatggctgagtcaccaggtaaggaaggtgtaggcaagagatggaaacatagaaaggggctcatcgcaaactccagtcttttcagaggaataagccagctgacgtgaggaactgctgacaaatgacactaatgaatcatagtggcattgggaattagcttgggaggggaggttaattcatattgtgaagaaatttagtgtgcagaatttgtcattctctaagatgaaatgggcattatttttagttttcttttgtttaaagctctgagtggggccttgaggtaccagctagaagttccagggcttgagtcctaggcctcttttcttggatttgctatcaaaagtggtgtggaatatttatccgcaaaaactgcagtatgctcgtctatatcatgggattaagaatgtcttcttatgttggccgggcgtggtggctcacgcctgtaatcccagcactttgggaggccaaggcgggtggatcatgaagacagagattgagaccatcctggctaacacggtgaaaacctgtctctactaaaaatacaaaaaaattagccaggcgtggtggtgggtgcctgcagtcccagctactctggaggctgaggcaggagaatggcgtgaacccaggaggcggagcttgcagtgagccgagattgcgccactgcactccatcctgggcgacagagcgaaattctgtctcaaaaaaaaaaaaaaaaaaaaaaagaatgtcttcttatgttccttaactctcagggttgttgggagggccaaagaaatgtgaagcatttctctgagcatatactatacatcgataacccaaaacaacactccaaacaagcctacattaaaaaaagaaatctttgctatctgtaaacactgcacttagttaagaccttgagcaaatacaatgcatttttttgagactgccttatcagcggtaagataaggataataatagtcatggtggttagttttctgtgtcaacttgactgcaccaagaaatgtccagattaaatgtcatttctgggtatgcctgtgaaggtgtctccatgtgagattagcattggatcagtggactcagttaagtagattgccacctccaatgtgtttggggatcaaccaatccattgagagtctgaatagaacaaaaaggtagagaaaggggaaacttaccccttttctttctcttgcctgcctttcctagctgggaaattgttctttcactgacaatggactaagatttacaccattggctcctctggttctcagacctttggacttgaaatggaatgaaatcaagggttttcctaggactccagcttgcagactgcaaatcatgaaacttctcagcctctataattacatgaggcaattcctcaaaataaatacatctctttctcacacatgtgtgtgtatctgtgtgtgtgtgtgtgtgtgtgtgtgtgtgtgtgtgtattgcttttttcctctggagaaccctaactagtacaacagtaaccagtcaacaagttgttatgatgattgaatatatcaatttatataatataccaagcagaatatctagcacatattagtgatcaatatttcttatcactaacgttattatcattatcaatatcagatttatagatattattcttaataaagttataatttccctcaaggttattcaaaccagtagctgatatttctctcaggtgtatttattctatgaacagtaataacttctctacaatagaggcctctctttatgatacatataagaaattttcattaatttattgtgatcatcaaaggtacaataaagacttcaaagtagaagctgcttcagttggtacagaaccctttatagaatagtttcacaggtagatcgagttctttttactgtttaaagatagaaatgatgaaacaaatttatattttggtggaaatatctttgttaataattattaagcagatggcattgtacataaagtttgcaaagaagcctactaaaatacagattggcttccttataactgggcttatcctcagtgtatcacagaatggtttagaacctgggaatgtcagcattagaatggggcatggaggttgactagtccactttaatctatcgtatcaacccatttattagagccttatatgcagtaactccagaactagaaactctcagctgtaattatcagttgcattaaatgctttccacagtgcaggaaacaacacataaccaaaatcaagttccccatgtactctggctcttccatagctagtgatatgaagctgttcatatctcttgattgtctgagcataatattactgatgattacaaaaccaaaaatcaacaaaaaccctgtttcttgagagagcatattgcatgctagaggcctcggtgtttggagaaaattaatggtcagttttttggagagaaaataacatgtgccaagccccacaggtgaggagtatagacttcacagcaagatcatcgaatgtctcaaggtaaggagagctcagaaagttgtagcaaacatggataaattgctagtgaggcaagcacttgctgaaatggctttccatagaggagtaagaaaattagcactggcccattcggttaacccaatattttaacaaaatgttcatttttactatcattcatttttaaatttatctttacttgtattgatatataacagttgtaatagattgagggtacacgtgaaattttgatacctgtataaaatgtgtaatgatcaaatcagcataattgggatagtcatcaccccaaacatttcatttttcttgctcgtggaagattaaacaatgctggcaaagaaatggtttcctttcctgccacttttccatgaaaaccaggctatagatggctaaaggccaatgtcactcctaaaacagtttcattataagtcattcagcaatctgaatactttattgttgcatttcagatagacaaatgtttactatccatgatgctatattacaatcacagatattctacatttacaacagtaggaagacataattttggaaaaagctgtttgcaattgactgtggatccattctatttataatattgaatataaacatgctaatactacagagaggaaaatgtcttcccagttgaattccctaacaagctgagacatagaatattaattctgcaccaatgttgatgaattctgattctaaaaatatttcttttaatgaatcatgaaattcttaagtttcaggttcgttgaaacaattagaatatgtttcagtttttagaacaaatgctttattaaaatgcacatttaaatgagacacttctctaagacctgatactttaagatgctaagtcctcaataacaataattaaagcttacatctcattactaataaagtgaaaaattgaatattgcttatgcactattaaaattcaattttattttataaaaaagtattaaatgctactgaatcaaaagtcaacactgattgataatttgtctgcatctattacatgaaagctatggccaaattagggatacaaatagagaaacacatgcctttctatcgtatacgagtaacaacccagggcatgggttttagtgtgatgaagatgtggtctcctatctcagcttcatgacttatcagctatttgacctagggctgcattctttagcttagctttaccttttattaaatgtggccactaatgcctaccacagtaacttgctgtgaggttaaaatgggaaaacacatgtcattttcttgcctttcaccagggagtgagacataaactgtttctctgtagggttactcttatcttaggccttcacttcctgccttggccgcatcacattcctccattataaacactttttcacacttagaagaattttacttgctcatttgttccgatttgggggtaagaagatagatattgcaaatttaaatataagctccatgaatgcaattactgtgtttcatttgcttttgctttgctttttcatttttactcaaacttttgtattttgtgcttctgctgtgactgtcatataataggtgcataagatgaataataaatacttgttgaataaacaaacacgtaaaaatccctgtaggtcatgggtgatacatttttaagaggggaataatattcaaaactaacaatgaaggtcaaatgagaagaagtggaatatgtcagaccaggaactaggaattcaggagaagtgtctggggcaacaccaagaatgagagtatctgggggaagcacgtggcagacagacccaggtgaccgtgcaaatcctctatcgctaacaacaaaagctttagtgaatgtatccacagcattactttgaaattcaaaggcaacacgtagctagggtgtcatctgcaagtagcaacatttctctattgatactataaattattacataaaaactagcaaaggaagacaaggatagtctttagagattttgcaaatacccggaggagttttcttaatgaagaggaaatattccgacatatgacagaaatctcataaccaggtataagcatcctataaaaaaaggaggattttttttaacttacagagctgtacctctgtagaacacgatagctaattctgctgcacattaggcagatgaagagacctgattcttccagtctacagatgggtcacagtcacatttgcaagagtagtctgtcacccagaaatgtggaggccaacagagcaccagcccaggacaccctttccctacacacaggtggcagaaatatgtggccctggcttgctggaagttctctactttaaaaccaactagcttctctctctcctgagtcccaaaagacagactgcctggcagcctcaacagctgttgcaatcacgccagtccagaggggaagagacccacaaaaccttcaaacacttcgaagcttaagctgattttgtcaactagaatttagttttacatgattcatcatttgaaccattactgcaaaatacttatgtgtgctaaaagaaaatctttgaagacctgatgcctaaatcactgaagaaccattatcgatttaggccacacagttgctatgagctgtttttgaatgatgctatttttgcatttttttccctcaagcagcaggcaattttgatacacctactccttgccaggcactatgttagccttagagattggaagggttaaacatagtgcaatgcttccattgtcacaaaataaagatgctgggcccacagatgtaaggtaacagatccaccactgagtaaaagggtttgattgtaaaagttgaaaaaataatgaaaaagaaaaattagttcttcagaaaataagaatgtaaaattggacctaatttttcttttcacaagcactaatagttaaaattctgttcataagtgaaacatagactctcaactattatcatttaaaatgcaattatgaaaatataataagtaatttttcatttcttttttcttttgtctaagtttctctacattatttattaattagttcttgcaaggatctcaagagataaggattatattgctaatatcctggttgtagagattttaataacttaactcaaatcagcaaagttaagattaaaataggaatgaaatgaacaagggaagttattttattgtataaaagaatttcagagttggaagaggttttgtagagtacctaatccaacctttgcattatataaaataagactgtgaagatgagcaacttgtttataggtcacacagttgctgacaggtccaatttcaaaaccacctcaaattactgtacatttctcattgcttctgttagccatccataccagtcattgcctaacaatttaagactagatactgggcaaggtgttgtgattttgtgaaccagaaatgcagttcttgttcattaggactcttctctataggagggtacaataaagggtttgaacattgcaatggaagagcaggaaacttcatgaactaagagagacaggtgtagttcttgttccctagaaataaatcccaatatgcatgcagagggacgatatggcccaggaacatttacaagaaatatgtatatctatatatttatatagatataaatacatatatatatatatacaccacagatggtatatatatttatatctatatatttagatatatctatatatttatatctatatatttagatatatctatatatagatatatttatatctatataaatataaaaagcaaagcaaaagcaatccacaggtggatatatatatatatatatatatatacaccccacaggtgttttttatatatatacaccacaggtggatatatatatatatatatatacacacacacacagacaccacaggtggagatatatatatatatatacacacacacacacacaccacaggtagatatatatatatatatacacacacacacatatatatatacacacatatatatatacacacacatatatatatacacacacatatatatatacacacacacacacacacacaccccccacaggtggatatatatatatgtgtacaccacaggtggagcatatatatatatgtgtgtgtgtgtgtgtgttctgcacagcatgagtacacatgcaataatataaaataatataagtggtaagggccctggtcactagagattgccttctgtatttaaaatgagagcaaccatactcaggcgtacctctctcttgccttgtgtgggcatgagctccatgtcaccagatttgattttttttttccagagacatcaacagtatagactttaggagatggtctaaagctcttagcttggttgctcgcctgagagaagcagagttagaacaagtgaagtctacccagttagcaaaagcacaatatataaagatcgtctttaaaattatttgtgtttaaattcacaccttccccttgggaatcttcgcacggatttgctaattgggtttctctgaatattcagttgttcaccgctgactgactagacttcccaaagccttgataactggagaatttccaaatgctgcatttttttcagccaggcagatggcatggtaatggtagatgtgaacttatgtcctttttccttttatagcagtgcctgagtatctgactgacctactgggattaatttactcttacaataggtgataatagagcccaattccagaagtggggtgctcagcagttcttgctaccatgtaccattttcacagccttaatgtgggaccagagcagtataagggcttaacatatattttctcctttattcaaacattactcctaagtactattattgttcaaattcagctagaaaactgagactcacagaggttagttaaacaactttcaaagtcaaacacctattaaatggttgagagtgactgaaatctggataccttaattttaaaagtcagtgctttcgctgttgtatctccccatgaggccaacccaagtggtcaaccagtaaaaaatttggtaagtatcatgtgattttctctacaaaacagtgaacaatctagtggacaacatttttcttttcagtttaaactagaaattcgtattttctttaaagtgtaaggtagaaatgactagatttcctggtatcttgtaaaggaggcaaaatcaacagtaagaagggggctaatattttcagtctctggggaccaattattacattgggtatacttccattataataaagatagatatacaaacatgcatgcatacatacatacatataaccatatcaaaaacaggcttgggtaacagaaaactaacaggaaaaaaatcctatagtttgaaagggaggtatcgaagttcaaagtagcactctctcttccgatgcattagtgatggtgttggaaatggcagtgggctggggaagggtaaaagcgatggtatgtatgtattaaggttctcttcctctaaccttggaatcacattaagtttcaaatacttgtcccataccctgctaactctatgaattttggcaagcaataaccatgtcaggcctttttttcgttgatcttggtggaaagaataaatgaaataatgtatatcaagtgcctgacagtgtccagcacagagtaggtacccataataatcacttcttctctttcctcctcctttactgattctctgctcagcagtggaggagtttcaaagcatggggcatattaatatggtaagattatttgaagatgttcatttagaatatgcaccagtattttcatttaaattagttcactcttcaaatcagcatggtgctccaaaaggtaacaatgttttggcgatgaatatgtgccagcaacttggattattttaaggcttgtataatatttatctatgaaaaaattttcccctttaaacattcaataagctcatagccatttgcttaagtattccatccaagcataaaagcttcccaatgaacgagagcactgtcttgtgacaaagcttatttctgtgtatttttaataagaaagggttcagaatggtgatttcttgatatccattcaggctttgaaaagagatcttatccaagcaatacattttctgaaagtgtaaagggagtggtaaactgttcagaaagggaggaggatctcatttctttctttttttttttcccccaggaaaaagttctctgcaaaaccacaggtggacataaaagtatccagacaactacactctcgcagagatcttaggactgttaaaaaaaaaaaaaaggaaatatacatatatatgcacaaaattgctgataaccataataaaaataatgcagaaattctccagacttggaaagtttaaaacattatgaaacttcttccttacagttacatagcacaattatttgtgtattcagctctgaaattttcgtcttcacaaatgacagtgaatattctgctgtagcagatgcttaatccattaaataagtgggagtcactaaaaaatccctgtctcatgaagtggaatcctactatttggctgaattttcctctggttttccaggaggaatacgcaggatacaaaatttgatactgacttctttatggtatcaagagtgacagttacataaaaacatatctggtctttctgacttttcaaaactatatttttacttaaattacaaacagaaaacagattttcatgttattggctggcgattttatgggatggaggatttaacagagctgtgatttagaattaattgtttgcttttctaaaaaaaacatagtcaacaactaccctaggagatctgacccagtaggtacttaaagcgaggatgggaaaggctgtattttctttttaaatcttctcagaaaaagtagcaatatatatcaaacatatgttaaaatagtaaaatatatgtaatataaatatatattatactcatatatgtttctatattatatgcatatatttaaatatacatatacaaatatgtatatatctacactgtatctcagaaattatctacaaatatgtcatttatcttgacatgtaaaagtacacatatacagaactgttcatgacagctttttttaaattattgaagaaatagactcaatttgaatggccaccagtggggaatgcgtttaaacgaattatgatacagccatataatggagtgccatgtaactagtagaaacacaatgttagatttatatagttgaaatagattaaataaaagctatccaacaaatctatctatattgttagattatggtatattgtagagtaaggcagaaaattttaggaaaattatacaggagaggagatctttattttcatcttaattccttctctgtgagctaaatgctattgttttcatttgtatttgcatgcattactttttactttaacggataaaacaaattaaaaaatgcacacagcaatcctgatgttcagccagtaccgagaacactgtggccctcatatcatgttaaggtgctagaacaaggtttaatcactagagtgtttgttgctccatcaacctaaaatattaatacaaattttgcccggggtaaaaaagtattcatttcatattaagaatgtttcaaaatattttgtttcaaaacatttttgaaacttaaaatgttttgaatcataaagcaaccttgagtaggtagcctacagaaaatgtggcacatatacaccatggaatactacgcagccataaaaaatgataagttcaagtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctagggactgtggtggggtgtggggaggggggagggatagcattaggagtatacctaatgctaaatgacgagttaatgggtgcagcacaccagcatggcacatgtatacacatgtaactaacctgcacattgtgcacatgtaccctaaaacttaaagtataataataataataataaaagaaatataatgggaaaaaaaacataactgagatgttttgatgttttaagtaactacctgaggtatgtttaagcaacatttaagtaacatgaatgaggttttgtttttttttttttttttgagacagagtctcgctctgttgccaggctggagtgcagtggcgcaatctcggctcactgcaatctccgcctcccgagttcaagcgattcttctgcctcagcctcccgagtagccaggattacaggcgggcacctccacaccctgctaacttttgtatttttagtagagacagcgtttcaccacgttggccaggatggtctcgatctcctaacctcgtgatccgcccgcctcggcctcccaaagtactgggattacaggtgtgagccccttccctcgcccggccaaggtatgttttaagtagactacctgcttgaggtagatttatgatacatacccattatcgtgacaatgaaataaaatgaaatgtgatgagaaagtgaaccattccacaccatcacctaagcagggcagcacacgaagacctgatgtaacgctgacaatgttaacacccctgtgtgatgtccaactaaaaataataaaaaaagaaggtgaaaaatttccccatgctgtcaatcaataatgatgtcatcatgaccctgatagaaaactcagtccaggaggttgatggtactaaattagaaatatccatctttccctttggcaaatcctcttttttttttttttttttgtcgtaagtattacatgctaaccttgtaatgagagggcagagaggtaatggggaccaacagcaaggaccctctggaagcctagagccttgggtcccatcctaaaagataagcactgagcacatcacacttaacctctcagcatttcaactttcctatcatctatgagatgagaataatacttgctatctaccccataaaggggttgaaagggatgctgagaaagtccatggaaagcactttgaacttctcagaagtaagattttacagaagtacaaagcctcacatcaaaagacacactcatacctttctgtgacatcaatgagtgtttcatagataggattatgcataggtctgacgctgaatgtgctttatcattaaaataatttctacggcaatttcttttctttttacctggacatatgaatgcatatgcagccttgacaaatcttatactccttctcagatcactgtgaggggtctctgaggctcatttttggctcaccaagctgtgttatttagccaacaggtataaaatgtggtaccccctacttctatctttaggcattgctagaaagtaatcttctggagaaagaaaagtagaataaatttcagtaggttattgatgacatcatgtgttatggccatatttgacacagaacagaactaattcattcaaactccttgttagcaccaacctcttctgaaattacagctgtttctactgctatctagtctacattattaagtaccacctgtgcactcagccctatagaggaatgttccatcagtcttggaaaaggaatttgtctgctagatagtgttaaaattacatagccattcaaatctttcttcgataccttgaaaatagattcttaatactggctatgtattaaaatcacctgagtccactggagaggagctaaatcataatctctgtggctgcttctgccacacagagatgttttatgagattccacatgtgcatgttaatagcagcactactcataatagccaagtagtggaaacagccaaatgtccatttgcagataaatgaataaaccagctagatatgtgggatgttattcagatgtaaacaaataaatggattactgatatgctacaacatggatggacctcaaaaacatcacactaagtgggaaaaaaagacacaaaaggtcacaggttgtgcaattccatttatatgaaatatccagaataggtaagtgtgtagacacagaattcagatttgtgattgccaggggtaagggagaggtgagaaacgaagaacaactgcttaatgagtatagattatccctttggtatgataagaatattttggaactagattgaaaatgttgatgcatgacattgtaaatgtatatatatgcatacatgcatacattcagacatagatttccaggtgtttacaaagcaatctgtgctaagagtcatggtctagagtttcaaacatggttgttgcaccagtaccattgcaactgtacagtgctggcccagtactatgcattgccttcaatcaccagtgcatttcttaatgcttttcttggtgtgacatagggagcatcacctgaagtactgagcatcttatatgagcatcacctggagtatttgcttgtgatgaatgcatattcccagtcttcactgcagacctacagactcataatctcataggagtaatagggcacggttatgcatttaaaatcattcctccaagttattcttatgcatttcatttttatttttaattgacaaataaaaatgcactacattttaaaacttgaaggccctactttggactttgccttactcttccctatttatcattttttgagctttattcatgacctacctccactgcttaatgctgagtatccattatctcttttaagcttcacaaatgacagcagtcttcatttataggagagaaaattaaggctgagaagaggaaaatgagttgcccccaagagttcacatttagaaactggaaaaacctgtaaccaaactttggtttttctcagaaaactttaaaccctttactctttcacaccttatcccttccaaggaccagttcctggtctctcattgtcccattgtcgctatcttctaatatttccctgtaatcatcgcagtcaccagataatcactgccacccgtccccagactcatcaactgatgaaccactattttcaatcatcttttcttgaaatttccagggctatttgacttcaggtaaagttgaccgtctccactttaacctgttgagaccaagtcagtcttgaatgagctcctctacccccaccctggctgttgcatttaatctttgcacctccctctgcccattttgcccaactatagagggagacgaggccctacctgtgtcccatcccttctcactacctgagcacccttcctcccaagctcatgcccccatccttgactctctccctctccatgaggtctaatatgacctttgattaaacatgcttaaattgtaccccacttccaagtaataacagctaagtttaaaagccgtgttgcttcttctttcttaaatattatcttatacctatcctttgtattttttcatcaccagtttttttcttatctcccctctcctcccaatgctgctctccttaaagttatcaaaaatccatcttcaggccaaatccatttgtcaatgttcagttcctcctcaacacctgcttcatctgacatttaatctccttaaactctcccctccctcagcctcagcctctgggtgatcagtctttgttttctttttctttttatttgtctcttctccagtaagtcccttaaacttttctgacccttagtatctttacctttaaaatagaaaaaaaaaaaaactaattcaggatgttgttatagaggctcaaccaggcaaaacctactttgtgtatgtgctcattgaacagacatttgttgcacatctcttgtatgcacagtactgagttaaacactggggtataaagatgacattgacgcggtccccaatgttgaagaactgtaaattgacttgaagaaacatgttgacaataacccggatgctttattcattcatttattaattcaattaattttgatcaagtgcctataatatgtcaagcagttatccaggcactgaagataaaacagtgaaccagtctgaataaatcactgcccttgtgtagcttacattttagtgacaagaaccacatagcaggctagataacatcagggaacataaatgctagcaaggtaaaaaaaaaaattaggataataaaatacagagttgtagcagtgagatgtgctagaagtggggtaagaaactacttctatgtggaaatgacgttagtccaagtcctaaatgatgacaagaagaatcagatattgagaaagtgtgctatatgaggaggacactgcaagtacaaatttcctggggttaaaatgaacttagcatatcaaacgggcagaaaggaagccaaaggagctttctgaacagtgaagagaaaagtggctcatgcctgtaatatcagcatttggggaggcccacattccgggatgatggcttgagccaggagtttgagtccagcctgggcaacataatgagatcccatccctgcttaaaaaaaaaaaaaaaaaaggacaaagacaaagaaaaaggcaggcatggtgcacacctgtagttccagctactggggaggctgaggtgggaggattgctggagtccaggagcttaagctagcagtgagctatgattatgccattgcacttcagcctgggtgacagagtaagacagtctcaagaaaagaaaaaaaagagagataagtaagagaatttggagaggttttggataccatgctaattaaggagtctagatttaattttaatgcgaaggaaagccactgggaggttttaggtaggagaatgtggtaatccaacaaatgctttaaagattatctgaaagctgcatggataattgattgtgctttgggagcagcagaaacaggatgactacttatgtccaccttagtagctcaggcaagagatgatggctgagattgggctgatggctgtggaaatggtgtgaaatgctcaaattttggttgctgaatgtgctttctaaggtctctctatatgcgtacttgttgttttccattttacctatcagaatttatattttttgagcactaggactttgctttggtcatttttccatgccacaatcgctagaacagtgcctgacacacagtaggtgctaaataaataaacatttgttgaattaaagaatgaatagcttgcatgtggatgctgagataaactcttaaatttggtgcttgagcactttcattgacagtgtgtcatcaactgagatgggaaagactaaaaaaggcacaagtttgtgaataaaaagcaagagttccacttttggcatgttcgatttgagacgtctcttgagagcagacacttctatacacatgtctggagctcagggcctgatatttttttcattcattcatgttttgtttccctatttgctgtgaaagcttggcaagaccagggtctccttaagtgtaccccccagacaagtgatatcaacataacctgcaacttgttagagatgcaatgttttgggctccacctcagaccaactgtatcagaaactctaggctgcggggcgtggtggctcacacctgtaatcccggcactttgggaggctgaggcaagtggatcacctgaggtcaggagtttgaggccagcctgacaaatatggtgaaaccctgtcctctactaaaaaatacaaaaattagctgggtatggtggcatgcgactgtagtcccagctactcgggaggctgagacagaagaattgcttgaacccaggaggcggaggttgcagtgagccgagatcatgccattgtactctagcctgggtgacacagcaagactcagtctcaaaaaaaaaaaaaaaagaaagaaagaaaaagaaacaccaggagatgagttcagcattctgcatttaaccagacctgttcatgactctgatgtgcatcaaggtttaggaaccactggtctaaaacactgccagacatagccataagaaagagctgaacatgatttggggcagctatgcaaagtagcaagccgttctgattgttttttcttgcctctcatcaaatctctctttatcatttgaactttcttagctgctttactttgtccttagaatcaaatattttctcttcttttaaattatgtaactatggttaacagcagaactttaaaaaaaattagcctttccaaacactttctcatctgtcacttaattttagcttctgagagctatgaaacagtagggatgggaattctagccccacttcacatacaaatatatgtaggcaaaatcccattaggtgatttattgatgatcacataaatttaggtagatttgagacataaaaaacattgacctcaagctttactcttaacactgatactaccgagtaaacagtaggtgctcaatacatatttaatgactaagtgaatgattcctcaaatagatgctgcaggattcaagaaaatgcaaatttactttatcatgtatgtacgcgtggaaaccagaatactacgtgaccccgaccttttctttaattggacacccacttccaagctctacccatattatccagcaatatgggaattttatgagggaggcagattataacctaaagttatgaataatcagtttcttatatctttaagacaataattgatatagtgtgctctaattcttaatgtggctacacttctcattctgtcaattacttgtgcatttgaaaacagaggtcagtgttccatgtcctgacctctgttttgaattacttgaagaaggcaaaaaactggtgatgctgagactgattcttgccaatgttatctgtctctctttattttaaaacttaaatcgcttccctacccctactggaatgcttttagcctatcgtacccatgataataatgaaacattcctacatttgcataaagctgtctcatttagcttagcttagacacagattttaaaaaacccagtagacattgaaacatagctagaatacggaaacattaatgatgtcaataataataataatagaaaacattttttgaatgttcactatgttccaaccactgggatgctggatgtggatggtaacatttacccgggatgtgaaggacttactatttttcgtatttcacagatggtcaagctatagctcagagagtttaaatacttttcacgtcatactgatagttcatagtgaagctgtgatttgaatccaggactgtcagactccaaaacccatggcattcaccacttttccacttcaagactgtcagcctccaaaatttatggtatgaactactttcccactcctacctcattaaaacaattagcattacatccgtgaatgcctgtcatctgtgttaacaactcaggcaatgagaagactggcctagttcatgtggtcaaatacagtgggtctattttaattatactcatgctccattgggtcacatggacataaatacatctggttagagtttttttgtttatgccttcaattacctggtttaaagcctagtcacaaacatgctccagctctttcattatggtggttggccatctcaagtttttacaccatttaatcctacctccaatctttgtttttcaccagcttctccagtccctttctgccattggctactggttgtatgctggaactcttgttattacagaaaaaaacacattttcagcttctattgcatagcaggcctattttgagcatgatggatacagcaatgaagaaaagcattaccttttctaaagtgccttacggtcaggtggggacgagagacatgtaaacaaataaggcattcagtttttccatattttagcctcagctctttgcaacttgtcttggctgtcaccctgggtgtcagctgcgcaggttctttccaacaaaagaaactcctgcttctccttctatcaaagggaacactatcctgctgattgaaagtttggcaaagcgcccaagactgtgtgtgtgtgtgtgtgtgtgtgtgtgtgtgtgtgcacgtgcgcttatgtgcattgtgcaatgtctaaacactcaaacaggatatttggaacagaactgtgtgattgtttcttatcagacctctttataagtgaccaatttaaagctgaagatgcattaaaacacaggcttcaggtgatcatctgtaatttaaacggagaaggtgagatggtcaggaatttagttctgagagttttgaccttatcatcaatagaaatgagcgtttatggtctttctatttaggaaagagtctctggctttaagcggctatgccttactgtgctttcataaaaggtcaatttgaaacattctgggcttttaatgtaccaatgaattacgggcaaaagcctttatcctaaaactattagataaaaattatatctttagttttgggataatatgaagaggcaaagccttcttcaggggactatacatagctatttataagtattcgtgattgctgtattgcacagtactgttaatttaaggcaaacatttttgcgttgtttaggatttttgaatgacatgcccatgacgtagtttgcgagaaagggaaaacacttggatgtagggcttgagatgaacttcggactcttccagcggccaagtgtaaatgttaggccacatgagcataaacacatctggctggaacttttcttaatgccttcaattacctggctttaagactagtcacaaacatgcaccagttctgatgtccatagtagacagagcttatctactagggtacattattttgctgaatccagagatagtctcagaatccttctcagcacagtgcttcagacattcactgatgatgtaggtaagtgggcccatgagatggaatatttttgtcattccaactataattcaaactcttttcgtttacagaggacaagactgatattcctaatggtgatgtgacttatttaagatcaaacagataagcagtcaagttgtcactacagccaaggatacacactgcttctacttcttggcccaagtgctttgaaaaagggaatcattttaggcaaggagacgttttctgactgagttgtcagctcttcttttcagctaaacatttatattaagagatttccattggcagagccccttctcacccccatgatgatcctagaatttaacagccggttttggagttcactgtgtctaatattgtctgctcttatttttgcagaggctattctatttccatagaaggcttgattataaaatcacacagtatagaaaatagttgtgtaaaaaaccttcaacagaaacactgaagggactctggctttaaatcaatgcttggctttaaatagggaagcaaatatcattgcgtaaaaaagataactaaaatatgactcattgctgggagaaaaggggatacttttgagaaaagatttctttaagattatgtcttacagagctgcttacacatcatacagagtattagaatggtttcattactacaagttaagagtcagattagaataatcattaaaagggaattccctgtattaaaaccaccaccttccactgaatcaattacactcctgtgtcatgaacatcaccaagaatcctagattcaacacagcattgaaagctggcatgaagattatttattaaccttagcattatcccaatttgacttgtcttactaatttttgtttcatccagtctcactaatggtcaccccattctcccagtcactatacccagaaacccaaatattatgttcgacttctttcattctctccctcatacacctaatctattaagtcctattggctctacgtctacaatacaagctagtgccatcaacctcttcccatcttcattattcccccaccctagttaatgctactgtcacttctccccagactataaaataaattacagaatgacagccctgcttctcctctttccttccactccaatttacacttctcatggtggttagactgattttcctacaacctgaatcagataatgtcactccaatgcctgaaattttcaaatagcaactgactgcaatctgaatcaatacaaactcctttagatagcttacaaatttctggaccctgcacatttccccagtcttatctcataatgttcttctgttcactcaccatgctcccaacagatacatcctttcaatattttaaacgcatgctctttcctatcgcaatgacttcccataaacagttcctttttatttattttttttgaaaacctttttcccctttctacacaagagtggatcctgctcatctttcaggtcttggttttgatgtcatctcatcagataccacccctccacaccccatagcagatgctttcaatactctgctcatatcaccttgggttgccctcttatcttcctgaacatgaatattcactcccaactgccagcatctgtgtctctttgttggaggatgaccttcaggcttccagaatgcctttgactgtacatggagagcctgaagtggctgtggatttgtatcccgcttcaccccagagtgcagccttagccaatgactgatggatgaggagtataaatgctccagcttcctggcttcatgatggatttagctctgcaattgaaatgtacttcccttacatcttccctgcaggattgagccagttatcctctgaggatctttgcttgatattgtgttcttatttattctccttccctttctggacctattttttacttccctaccacttctctgggagcaatttctaataaatcacattgacacaaaatctcatctcaggatctgcttctgcaaaagcacgctaagagacaactccaacttttactcaattactctccatcagtgaatcccatttattttattccaagcatttatcaaaaactgttgttatatattgaatttcttgttcacttgtctatatctctcattcaactgtgaacaaactgaggacatggactgtatccttttaaaactagtatacctccagcacctagcacactgtttggacatagtagttgcctaactaatgtttatttttaagagtgaatgaataaataacaaaatccttcctggtccccctgttcatccaggctgaattccttcttcctgctctggtttccatgatgtccatcaagtagcttctgatcagaattcaggttttcatggagcttgactataagggtagcatatcttggtcacactgacatgagtaattggtccatatgataattctccttgttgtaatatgccgttctcctttgagaatacactatatgccaggcagcactaaggtagagacacaatattttattaaatcctagcaaacagctttgtgaggaagatacattacctttgtttttcagaagagaaaactaatattcagagctaaggaatgtgcccaaggtcatccaaatggttagtggcgaaggctgtattagaatccaagagtgactgcaaacccgtgttcttaaccttcatcatgccacctctgttctatgtgaagtttacttagcttcttgagccattctcttgggaataattaagttaaaagactaagcttctgggccttcaaagtagagggccaaatcctagaatgttatgacttatttgagccactactcagctccagctggccttgaccttcaaatcggcaccaccactttctgttcctgccagagccggtgctctaagacaacttgtataactctaaatgtatagccaactttctgtttaattttttaattttattttttgcgacagggtctcactgtgtcatgcaggctagagtgatcgtagctcactatggactccaactcctggctcaagtgatcctcaccctcagccccctgagcttctgggactagaggcatgcaccaccatgcctgactaattaaattttttttctttttttggtagagatgagatttcactgtgttttccaagctggtctggaattcctggccttaagcaccttagactcccaaagtgctgggattacaggtgtgagccaccatgcccagcccaatatatatatacgtgtgtgtgtgtgtgtgtgtgtgtatccttatctgtggtagacattggctatatagccatccaaatcgttagtggtgaaggctctattgaatccaagtctgactgcaaagctcatgttcttaaacctcatcatgcagcctctgtcctatgtgaagtttgcttagcaaactctacacatcccaatttctaccacagagaatggaggctaaagagttgttctgatattcagcaatctacaaataaattttcagctgatggtcaaaagagacaacagtctggaaaacatgaaaagccaaaggaatgacttaggaatagaaataattcactaatttattcaattaatgatatttatccaacatctagatatgccaagtatgcacttgatacaagaaagacaaagcaaaatgagaatcagaaagggtccttacaacactggcatggagatgattagcatggtggttaggaacgtgatgtagaggctgagagttcatgtttagacaactcactgctgaactggaatgcaggctctgtctcttccttactggctgtgttatttaatctgtgccacatttattcctgtgtaaaatgaggatgaaaatactacacccaccatgctcatcaaggtgtcctaaagattaaatgacttaatgtttataaagtttttggagcagtctctgacacatatgatagccatgtaagtttgttcaataaacaaagcagagattggagctaaaataaaataaatgaaagatattatggggatgcagaaaagagaaacttagcctggcgagaaggtgcaaaaaccagaaaaggatcacaaagatgtaacatttaaagcgggtcttaaggccaggcacagtggctcacacctgtaatcccagcagtttgggaggctgaggcaggtagatcactttaggtcaggtgttcgagaccagcctggccaacatggtgaaactcccatctctactaaaaataaaacacttagccaggcgtggtgacttgcgcctgtgatcccggcaactcgggaggctgaggcacaagaattgcttgaatccaaaaggtgaacattgcagtgagccgagatcataccactgcattccagcctgagtgacagagcgagactctgcctcaaataataataataataataataacaacaataataataacgtgagtcctaaaagatggtttggaattcaccaatgaaagaagtgagaggaaaaaaaagagggagacaggccccagcaccagcacaggcaaaagcaggcaggagggaagctactggttgtttacctgaatgtgtttgcataagaagtgagaggatggggagtgatgagatattaggttattgcttaaaaggaattaggacattaagggccttgggaagcaataaagaagtttgacttcatgttatctagaagtaactttaagaaaattttaagtaaaaataatttcacgatcggagttacaaactacaaagtccactctggccacagtatggaagatggcttttgttgagtgaagtcatccacttaccgagttgccagattaagccaggtaagaatgacaggagccttaaataatgaactatcactggaaagtatatttataggaaataatagcaacagacaagccaattttgttttcaatggtcaaattagcagtagttcattttgaataaagttattgacctctgaggcaaagagatagaatcataatggaaaataagttccacaatcagaagtcagcactccaaattaaaagccagtcttcacctatttgatgggtggaaggacacttaaacaatcactgtttgtttctgacttttgaacacatcaaagaaagcatcaatttttatgttacctgagacactgaagaaacaattacatatttaaaagggctaaggaactttgcaaagtgtctataaacaaggtaattattcagaattaattcagtaagaccataataatgattgttacaatttcttgagcacttgctcatttccattgtgctagcaatttacatatattatctcatttatattattatctcacaataattcaataaggtaggtactatcagtcccatttaacagatgaaaaatgggggtttaaagagatttagatactcacttaaatgtcaagaggtagagcagaaaacccaagtctttccacatgtacagagcccacactgataacatctgtggtatcagttctcactgtgaatttatttgaactcagacattctttttaaggaaataaaaatgcaactttacgaagcgtacaatggagagtaaagaggatgcttttcctattatagtcatttttgcacaaattatccttctcacttttcatatactaatgatgttttcactgaggctgagcatttgactaaagtaacaaattattccttaaaaacaaaatgccaaggaaacaaaaaaaaacatgaaaatacattgaggacaactcagactgtcaatttgatagcagttacctgttaacagaaagggttatactatagtgatgacaacttggattccctggatttagccagaatggaatgtgactctcagctctattatttacaaactgggcaaaaacttatggctaaagctaagaagtaaaaaatgaggacgtttgacctaggctaaagtgcatgtggggtgtatctattaggcagaaggagctgcatctgcgaatgtcccaagtacaggtagatcttgtcttaattataaacctacaagtacttcagcatagctggaaaataaagcacacaagatggtgtgtcaagaggttaaaccagaacaatggcagaggccttggacaccatggtaaggagcctgcccatggttttataggggagagtgatgcaatcataatttggctatagtgaggaagaaggactggaaagctactagaaaggtaaggaaacatcttaagacattgccttaacgatccaagtgaaacgtggttagctaaggtcttgggctagtcacgtagtctatgtctcagtttccttatctgtaaaatgagatgacagctgctataatgtaggttatgtgtgagattgaatgagatgatatggtcaaagtgcccagctcagctatgaccactgtaaatagaacgatgtgatgcttgatgaacacaatggatgctgactcaagtttatatttctttcaaatatgactgactcaaaaatgtcatgttgttaaaatttgtccagctagaagaatattcatagtgacagtcctctactgtttaatgtgtattttaattgaatttgtttcttattgaagagtgcattaagctgccttttaattctctcatgacaataataccatggtgttatgtttgactaacctcgggtcctgcatgaataaaggtagattaaaaaaaaaaaaactcttctgacactatgttgaataggagtggtgggagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagcgttgttgaattttgtcaaaggccttttctgcatctgttgagataatcatgtggtttttgtctttggttctgtttatatgctggattacatttattgatttgcgtatattgaaccagccttgcatcccagggatgaagcccacttgatcgtggtggataagctttttgatgtgctgctggattcggtttgccagtattttattgaggatttttgcatcaatgttcatcaaggatattggtctaaaattctcttttttggttgtgtctctgcccggctttggtatcaagatgatgctggcctcataaaatgagttagggaggattccctctttttctattgattggaatagtttcagaaggaatggtaccagttcctccttgtacctctggtagaattcagctgtgaatccatctggtcctggactctttttggttggtatgctattgattattgccacaatatcagatcctgttattggtctattcagagattcaacttcttcctggggagttattcttatactttctatcctgtgtacaatataacaaccccacagctaaattttacaacattataaaaggtcacttttaatgatttaggcctttcatgtatcaatctttctacattaacattttctggaatttcaacatcagagttttcttaaactaagtgaataaatattcaagtctctgtgtattttgaaatgactctttgcataataatgtttttatatgaaaatggagtctctgggtgcacataaacaggttttactgatcttttaatggaaccaactgaagcacagaggcctttaatatcaaacacagtgctctcaatgtttataaatatttgtatagggatgccacttcccgttttaatattttgttactttaacaccagtaccactgtttcctctcattaattagctattgatgttttctaaaattaactttgcagacagtgttcactgacagagttctaaactaatgagtctgactttgtcttgagggaggcagaggaggggaggtggtcacagacatgcaaggagacagtgttgctttctgcttcaacacttcaaggggcagaggaacatttcttttacatgtggcctttgagcctgtgaggcatttgagcaaggaacacctcattcaccaatattttccaaacacattttaaaacccatgtgctaagggttttgatagagatggtattgggtgctatgggaagacacccaagacccacctagtccagtcctggcaacggtcaagaaaacttcctgggcaaaactatggctaaagccaagacgtaaagaatgaggatgtttgacctaggctaaggtgcatgtggggtgtgtctatcaggcaggaggagctacatctgcaaatgtcccaagtacaggtagatcttgtcttaattataaacctacaagtacttcagcatagctgaaaaataaagcacacaagatggtatgtcaaggggttaagccagaacagtggaagaggccttgtataccatggtaaggagcctgcccatggttttatagaggagagtgatataatcacaatttggctatagtgagaaagaaggactggaaagctactaaaaaggtgagaaaacatcttgagaggtttccttaatgatccaagtgaaacatggtttgctaatgatagaagagacagagaagatgtattgagacaaagtaaattaggatatctaatagacagagtttgcctattgactagacatcataagtaagtgtgatgcggactatagctgcccaggtaaatccaaggagtctgtctctatgtttttcactgactccttaatttccagcttgttttatttatttttatttatttatttggggggacagggtctcagtccaatgtccaggttggagtgcagtggtgtgatcatggctcactgcagcctcaacctcctgggctccagcaatcttcccacctcggcctcccaagtagctgggcctacaggtgcatgccaccatgcccagctaatttttgtatgttttgtagcatcatgttgcccaggctgatctccaactcctgagctcaagcaatcctcccacctcagcctcttaaagtgctgggattttaggcatgagccactgcgcccgccccagcttcattttagagtgctgggtgaatactgccacatctcgataacctaaattagaaatttacaggaagagaagaaatacatggctcaaaagttggggggaagaaaaggatggcagctgcatagaaagaacagggactcaagagatcagagctcaaattgggcaggcacaattctcattacctgtatgattttaagaattggttttggttttggatgtgagctaaaaagaaagacagtttggcgaaagatcctaaactatatctacattagttcttccctgttactcttcaaatttagagcaaagcccatttgaatttattgggttgagtacttaactcaataagcaaatcaggtattttgggataagagcatgagtgggagcatttcatactctaggtaaacagtttaaccaccggggagtatcataggctcaaagacttttcaggctctgacggtgttaagcaatacctagcacaatggttcccaaccatttctagtcatggactctgttggtcaaattaacacttacacggaaatccagaatgccaaatataaaaagggatgaaagtggagctgctttggttaaggaaggtatgaggtaccagccattgggcctaccctcagctgccaaggaaaacaattctgcagaacccagaagtattgctaatgtgcagacatacactcagactcgaggagtgctgctgagggttggtaggtagtaacgtaaacgtgttaagatgatagaacacctaaaaccatgctactgattgtaaaacagttcaaaatactattagatttaattcatcaaatagatcaaggtcaactttaactgtagaaaataagagttattatgcacatgataattatgtatgaagaaatacaaagccaccaaaatataatctgccacctttttctggtttctccattaataaatatttgctattagctcattcaattaatttttttccagcacttggaagaagacacattaatttaagaatagattgtacccaggtgcggtggctcacacctgtaatcccagcacattgggaggccaaggagggcagatcacttgaggccaggagttcaagaccagcctggccaacaaggtgaaaacccgtctctactaaaaattcaaaaattagccaggaatgtggtgtgcacctatagttacagctattcagggggctgaggcaggagaattgcttgaacctgggaagcagaagtagcagtgagctgagatcacaccattgtactccagcctggtcaacagatcaagtccctgtccccaaaaaaaaaaaaaaaaaagattgtaaaagaaaattctaaattataaaagctctatccacttattttttccttgtgaaacaggaagtgtttgcattattgaatttagggtaaagagaaggatcttggtctaacctgaaatactggtactttccaataatacagtttgggaaccagagttttaatctagtcatatgatttttaacacacgaaatctgaggcattcaggggtccctctgtaaggtcattaaccaaaccaaagtttattgatttatttttctgtaacagtgtctgacaggttatggtcagagactttccatgtggaatggagacaatcaggtagaaaagatttgcttttcatttctagtactgagctttcagtctagacaaagtaaagactgttggtggtcagtaaaaaggactttcttatgctgtgaaatatagcattttaggagatgcagcattactcgtgcaactgtgttcatctgctttattaacatgtgttatttatgatgctcagggtgccaatgcttatagatagttcttggaaacaattttactaatgttgtccaaaggtctgatggggtccaaaaaaaagaggcctctgggggactgcctgtcacagggtaggggagaggatataaagatgggagaggtcttggcttcataatcacccccaggtgctttggggctacacttccagaagcttgggatcaatgggagaaataaaatccttccgtaaataatgcagtgtgtttctataaggctcgcacacacataagaaggaaaagggacaggaactattggttgaaacaggaaaggaaagtaattatctgctggtttggcagtgatttatcgagaatgggaaagcaaatcattaccaatcaagaaagctcttaggatagggcaaggcagagaggtaaaactattagatgcattcagaaagaatttatgtgctttcttcatcagcaaccccatacattttactgtatttttaaaaaattgtcattacttagaaactgtgaaatatgaagaatgccttcttagtcaagtagcatttttatttgaggtgaactgcattgctagcagtttatttcgtgcagttttatagtggtcaggcacatggactcaaagctggactgctgggttccattcatagctaggtattttttggacattttccttaacctctctgccttcgtttcatcatacataattcaggataatagcagtaccgaccccataaagttgttgggaagtgtaaatgaattattgtatgaaaagctctgggaatattacctagcacattacaaatgctatattagagttggctattattatttattcatatataaaaacaacactaaattataataatagctcatgtttattgagtgcttactgtgagtcatatattttcccaagcattttatatgcaagtcagtcatcagatcttcatggcaaactattagatagagttattattatccccattttacggataaggaaattggcagcaaaactcaggcctggagctctttattactatcccttcatctctttaatatgaatttccttttccagtcttttcacatagtttccttcttcgtgtagagaaattaacaaaatgaatgtactttgaaggaggctaatccaagtaaagaagacttaagacaagctatgcctgtttaattcagctcaacaattcacaccttcataagccatgacaccattctcactgtatttcattttaatgctattattttgcttggtgactggtacatataaatattttatacagactcttctctttgtgccattaggatgatgaaatgtatatatgctaatggaattctaaggttctctgatttttcttttagggtcaattgtcaattatctacagcacaattattgtaagttgaagcaattctttcttccacttttctctatcagtatcgtctttgttgagatgaagcattttagtggcaatagacttactcataacatagctagaattgcagtgtctcattttattgtgtcactgccaaggatgatactggcagattcttaaggtactgctttgttgacaatgtagttgacactatttattgttattcttaattattactgatagtacatcaaaagtggaaaaggacaattgaataaacatatccttatcaatttgacctcttctaagaaatacatgatccccttgacttaacacaattcctggtcaatataagtgtctgccccactacacccccattacctgcctaatcagacctacctactgtatcctctatagcaatttcttcctaattgttgactgttctaatggacagtatgttcggaggaggcaacatggagcaatggagaaattgctgctgagttatctcccacagaaagtctgacttccctcctgtattatcctatctcagtgaaagccatttacattcaagtaggcactcaagccaggatctgagagtcatcttttaacagtgacagtgagaaatgatgactagtaaaggaatcgggggagagtggcttgactcactccataatcctcatcattatactctttccatgatcgttttactttccatacctttattcataacatttcctcaattctatgtagaatgctattttaacatatttaatacagtgtaatatccttatctctccaaattgcagagcttctaaattccacttacactaaaacctgaagctgctgcaattcttccaactttttctcttactatacccaaatcccatgaaaggtgatgaaaggtggatcactcgtttctatatactacagctgtacctcatatacacttctattattgcactttccacacttcatgtatgcatgcacgtgtgtatgtacatatggaaggtgtgtgtctccatttgactggagctctccaagggccaggtcttattcatatctaaatttgaaatacgcaacacaattcctagtatgcagcaggacaggtgtgcttattaaattattgcagaataaacagatgatggataaaagaatgattagactaagggtctgcttgcaggtctcatatgaccttggaaaaaatcaggtaatttctcactgcttaagtttgttctttcattaaaaatacaaattattttaaagacttataataatacatgttctatgaaacagatgctcctgtgaacaacaaactaggatacacttgtaaacccttccacttgctgtgaagtaccatgcctgtgtgtgagaattaaaaattgtggatccaatcaaagaagtataaggacagaaaaactatccttgaatatgttttcaagatgtgtactgtttgaaactatatctcaggtaacaatcaacagttttaagaaagagctttagaaatccaatcacaaagaaaagaatctttatttctccctttgggatatgacatttaacaaattaatttagaattctttaaaaccaacggagctaagaggaaattgagaacacttgtactaatcactcccaacttaaatgtagaaggtcatatatctaaaaggttacattactacaatggagaaattcaattactacggactcctaaagggctttacttaaaatagcacagaactgtaatgctgtcaattccaatgaaaataattgcatttccctaaatactgtgaataatttggtaaatacatctattctcttaaagtacaaatttccaacatctgcagaactcaagagcccaaaacataaatattcaaatatttcatcgagagttttaaatttattaataccaccaagtttactcagctgtttctatacttggatgactgatttttgtctgaagtttagtaaagaggagggtatcttgcttcaaactcactatgaagattgttaatttgattttttttcttcttttaacaaacaattcttttaggaatttcttaaaaattaaatgtgacaatctaggtccatagaatgttaaaatttaaaagaaattgatcctctaatcccatggcactcaaacctaaagccattactcaaatatagctaattctgggccctggtgttaatattcagatcctgttggtcagaattgggtacatttgataggaaccatcattggttctgatatgctgattcatggatctgcatagttatctatagatttctaattcagccttttatctttagagatgaagacgttgagatcctgacagcaaaaataatttctgaaagaccctctggactcttacagctgtgattcaaaacccaggtctcctgacttccagtggagtgctcctttataccatgagacatcctggaaggtcacacacctgggcatcagtgttcagagtacactgttatgagcccatgctgaatgcctctagccacatgagatcacatggattaataggtctataaaacaggaaacctcaatgcgagcaactcagcctagcaaagcagaatgaacaaatgggcactcaaatcatgcaagtgtttacacttctaattatgaaaattgttaacagagcttccctttattaattctcaccacaggccaggtctaaataaaatcaggcaatcctcccaacactcctatgagaaagcctagtgcaattcttattttatacagataaggaggactctgagcaaggaaatctagcataacaataaatagtagatggctgggacaaaagtcaaactcagttctctttgctattttcaccattccccttgtcctttccttcctgttgtagggaaataagatacttcaaggtttagcatttttgtatgaacgttgtagaattccaattgcggaggctttgccttcatgcatgagggtcaagcagtactttactatgagatagaccaagggtgtccaatcttttggcttccctggaccacaatggaaaaagaagaattgtcttgggccagacataaaatacactaacagtaatgatagctgatgagttataaaagaattgcaaaaaaaaactcatgatgctttaataaagtttacacatttgtgttggggccacagtcaaaaccattctgggctacatgtggcctgcaggcagcaggttggacaaacttgatatagaacttcctcaagcaaatggtgccactacattctgtccaaccgggtaacaaaataccctaggaaaatagtagcttttattcacaacacacaaccaggcgccaccttaatccacagtgcctgtgaatgtgaccgtttaaattaaaatgcagtcacaaccctgctgacaccttggttccagacttctagcctccagaactgtgagacaatacatttctgtggtttaagccaccctgtttgtggtagtttgtttcagtagtcctagtaaactgagattttctctttttttttttttttttttgggtagatacagtgtttcaccatgttggccaggctggtctcgaacgcttgacttcaagtagtgatccacctgcctcagcctcccaaagtgctgggatcacaggcgtgagccaccgcacccagtcttttcatgtctttaggtcagattcctcatcattggattctgagatggtaatagtgctgacaagtgctttgagtttgaagttgttcaacttgaccctggtctatgtgtcttacctattttgtttcatgttgcaagcactgctagctttcctattcaatacccatcctcccttctttttttctaatagaaagctacttttgtttgtaatgacagtggcccatctataaacttcaacttcccagactcccttgcaactagaaatgattttatgatatagttttgggccaatgaggtgtaaacagaggtctgctaaggagctctgagaatttttgtttgtccgtttactcatcaattcattcctttattttaatatcagtgtcattccttctttcttcactatttattctccatcctgtctggaacatgaatatgaggttagagttgcagcaacaatgttgagactatggatgataagtgtgataaaagccatatgctaagcacggtgtgaagtcaagatataactctgtcaggacttcagcctttttattgagaggaaaaatatacatatagttaagcaactaaagtaagatttttgtgttcatatagccgtattcaattccaactggcaaataataggaaatcagctgtggccccagagaaaagatccacagataggaacttttcaggctcttctgatgaaaatgactagatttttcaactcatcagcctacagtgaaagtcaccaataaacaaggtctgctcagtcatacagaatgcaatcagcatattattatctcactctgaaatattcatagagagccaaggatggaaaagcagagatcaaaacaaatagtataaggaattcagaggctacagattcagtgcaggaaacaaacaaaaataaattttaaaaatatatttgataccctagggtaacatttttaaaagggtcacataaatggaacaagaataagtagccattgtataataaaagaggaaaacacagtaataaacaactctcataaattcaaagaaaattgttagcagatataaaaaggagttcattaaggaagagtaaaaataaatttaagagaatctcacataaagaaatacgttttagaagtgctgcaaagtcagaggtaaacaattagaaaattgcaatagcaattcaagagactcaatatctgactaacagaatttacagaaagacaaagcagaatcaataaaagagaaacacatttcaaggaaataaagcaaaataattcgccagagttgaagcattaggccgtcagattcaaagggcctatcaaaggcacaaaacagtgaaagaaaagaaatccatactgaggcacatttttctgaattttacagcacctggataaagataaaatgctaaacagcttccagacagaaaaaataaaataggttagatgaaaagaatggcgttctgcttttaaacaagatatgagaatatgaaaaagtaaagctttaaaaaatcggaagaaaactgttctcctaaattccaatataaattataggtcatgtgtgatgagatttttttttaattgagagtgaaaatctttgtaaaaaattcccactttctttcttgggaagtaatggaagacacacttcactaatgagagagcagcaaatcagaagaggatgtggaatgtaacccaagaaagaggtaaagataattctttgttaacttttattttaagttcaggggcacatgtgcaggtttgtcatataggtaaactcatgtcacaggagtttgttgcacagatttttactcaggaattaagcgtagtacccaatagttatttgttctgctcctctccctcctcccaccctccaccctccagtaggccccagtgtctattgttcccctctctgtgtccatgagttctcatcacttagcatctatttataagtgagaacatgtggtaattgttcctgaattagtatgctaaggataatggcctccagctccatccaggttgccacaaaagacattatctccttcttttttatggctgcatagtattccatgatgtatatgtaaaatagcagagacatggaatcaacttaaatgcccatcagtgacagattggataaagaaaatgtagtacatatacaccatgaaatactatgcagcaaagagagttctaagtgagcctgaggagacctagagaacagctgccaatggcaacaagaggaaagtgttaaggagagatgtccccaagggcagaggggagatggggaattacagtttgagattaaaattgaaattggcaaattatacatatacagaaactttggcaaatgaaaacaaaaagatgccatttttactctaaggaaaacaaggtagtaaatgcaatcgtatgctatctagaagaggtgggaatagtattacatgactgtaataatgcaagcccttgaatgttgagtgaaaacatcaggaggttggtgataagggagaatgtgtatagagataaaggggtgttgttagagaggataatcctcatgttccatatgtggaagacaggtaatacctgaaatggaaaactcaaggacgatgagtaagaacagatgtattatgaaagcttatattaggttggtggaaacgtaatatggcttgccattacttttaatggcaaaaaccacaactacttattttgcatcaacgtaatggtagaacaaacagtcaaaagtttcaaggaaattgcatctatgaagcagaattcagagttagggtagggtggcacaagttgctgcttttctggttttcttcttgtgtatttttctgttataggtgaagggtcacaagctttaaggtacaatttcattttcttttttaaaagttcatgtagtactttaattaaagtcaatattaaataaaaatatttggctttggatttactttttgaaaactgagttttggtattggcctattgtttcaccatacagaactttaaagattatatatatatatatacatacatacatatacacacacacacatatatatatgccctacacatccatagtagtaaaaacctagaaacaagagctaatattaaatatattaatattaataatttaatatcaattaaattattcatcaaatattaattcagccagcttctagtctaggcactggtgatacatcagtggacacagtagatggacctccctgttgataacaagtgtatattttgggtgtgttcagatagaatatccttggctaagtcacgtactataatctatttgagccctggcttcctcttctgtaaaatgggcatacaattaaccactcattatttcaaaaattaattatgaggacctgttcagcttaaaatttttttccatgttaagatacaacatctcacaaagcagcactttactattaaaagagttcatttcgccatcattcctagcactagcaaattgaactattagggatgagacctccaatattacactactgccacattcctctttattatgaaaaggcagattgccaaaatcagtttctagtcactcagtttgtctaaatattgcagggctttttgatgttgcattagcagaatatacagtctacatttattccattcttttgtcggcctatgcaaaaaaatgaaatgaatctattcaaaatcaagatgcactgaactgcatatgatgcaaaagaaggattttgctaaacacagcaactatgtaatgcaccccattccttccccatcagcttggatcctgagactattttgtaaatctgcagagataagagttttctatatttattgaaaggtcaaaagtttgggaggtggagaggtgtaaggcaggtaggaatacagtattgtatttattaaacaatatgtcagaaacagacacatagcaggcactttgtaaagtacaatagaaaacaagcacctgttatctctaccactctaatttgcaccatcatttctagtaacagcaaaagcctccaaagtggttttcatacttctacctttcccattcccccatgaagacatccattagaatgatccactgaaaatataaaccatatcataacacttttctctccaaactttcattattttccccaaaagtccaaattttcttcaataacctacagaaagtatttgttaaatgaaagaatcaacccatctagcaaccaccagtgagacttgggtcactagatccttgcaatgtgttaagtaatacaattgaaataaaaagcaattagaacactggaaaacctactattctatggtatcactacatggtagtactgggaactaggacatgtgttgtgagtaaggactggaagttaagagaagtttatgtgggccatagtggtttgggtttcttgcgtagcagagactcaagtgtgagttggagatgtgaatgctccagtcattatgttgttatttaattaaatacaagaaagaaaagaacccatacacctgtatatctcaagtccacagctatcacgtcctcaattctataagatacgctttatcctctctataatagtttaaatgatctatttttaacaaaaaaagttacattttcttctttttttttttttttttgagatggagtcttgttctgttccccaggcaggagtgcagtggcgcgatcttggctcaccacaacatccacctcctgggttcaagcaactctccttcctcagcctcccaagtagctgggactacaggcacgcaccaccacgcccagctaatttttgtattttttagtagcaatggggtttcaccatattagccaggttggccttgaactcctgacctcaggtgatccacccacctcagcctcccagagtgctggaattacaggtgtgagtcaccgcacccagccaaaaaacagctactcctatggatgcagtaacactgcactggaatagacagatacataggtgacatacatggactgaaataaaatctgattgatgtgtcaagtttagagcagtgacagactcactgtgaagatggtagagaaacttgaactccagtaaactctgttatctggaatccaataaattgcaaagtgattaagtggtctctttgcacttaggtacacacctaactgatattctaagtagtctttgagaccctgaatttacacaactcaaggagagattaaattgtgtgcagcatcatgagagtgttgggtttattttattgcattccaattatttgaaaattgataacctgtgtacatatggcaacttcccattgatctgaatattggattaagtgaaacactctgaaattgccaactgaactgattgcacctaatgagatggagatgtggaaatagccatgagcttttcatcaccggctgcaaacctgcaattttcttggtgaagaaagaaaacacaaaatgctattggaaagtggttttcatgtcttgcacaaccccttcatccataaccttcaattctagatggctgcatactgttcacttggctaacttctagaatagagtggtggattctaggcaacaggatgtgatcactaaaaagacataaaacaattctaaaaatgtgttttgaaaaatatcaggtaagttctcataagtgagacattctcagtttaggtaaagcttagaattgtgtttcccaaatttcagttagtcacgtagctacctgtaattgcactagcaaatctacatttaatttatatgttatttgttatttttcttacgttaattcatttaacttacacttaaatacattattgttaaaggaaatattatatcactaccaaactataagtagatatcttttaccataaagagataactacaaatataaataaaatattgtcttcaaatattagttctgagttcaggactgtgatctctttgccaaaagagaaatatacaagcatttgtgatgtgttaaagactggcaccaaaagatgtgtgagtgtgtgtgtgtgtgtgtgtgtgtgtgtgtgtgtgtaatgctgttaaaatttagttaagcttttaaatacatttttaaaattggtatctttactataaggctacttgaagtctataaaatgctaaaaagtattgttattttctcagacaggtttatgttatccagtgtttcacaatatgtgtagagcatgaaatattttttaggcagaaaatataagaagatgcatatttctctcaatgtgtgctggcaaattgtgctgttgcttttgctgtttttcaaattccttcatgcctctatgatactctttgcttctgctcagtaagttagtcactctttcttaaacatgacacagttttcatctccattcttgactcatagtatttccttcactgctgcctcactttcagcggttaaaatacatctctttgccacccaaatacttgcacacaaaatagccaaaaagtgagaacacccaaatctccgtcaactgctgaatggttaaacacgtggcaaactcatagaagggatactatttagcaataaaagactgaattactcacatgtgctactacatcaatgggtcacaaatgctaagtaaaaaagaaacaacaaaaactagacacaaaaggccccattttctatgaatatatttgtacgaagtatccagaaaaggaaaatctataaagacggaaagtagattagtagttgcctggtgggagtggaggttaactgtaaatgggtaggtgggatcttatttggatgaaagaactgtcctaaaattggttagatatcatgattgtacaacttggtatatttataaaaattgacttttatatttaaaatgggtgaatcttttgaaatatacatttttccttcataaaattatgtaaaaatttcagccagctaggtggacaatcaaccacctatccattgacccattcttccatcttttaacgttttctctctcatgccataatctgaaggtgatttattcttgtcttgagaaaacataccattatgttttcatatatcatagatcttttcatttgtctttcttgtatgatattcaaatatttgtctaatatccttactcgaccataagtttttacagacaaactactctgaactagtccatgtgaaaataaatacttattgaatctatatatacatatgaagcaaattctatttcatggggaggggggaggggggagggatagcattaggagatatacctaatgctagatgacgagttaatgggtgcagcacacaaacatggcacatgtatacatatgtaacaagcctgcaccttgtgcacatgtaccctaaagcttaaagtataataataaaataaataaataaataaatcatgctactataaagacacacacacaaaaaaaataaaaataaaaacaagtaaaaatacccattagcacatattattaaattgcctgctttgaaatctgcaatttactggccgggcacggtggctcacacctgtaatcccagtactttgggaggccgaggtgggcagatcacgaggtcaggagattgagaccatgctggctaacacggtgaaaccccatctctaccaaaaatacaaaaaattagccaggtgtggtggcgggcgcctgtagtcccagctacttgggaggctgaggcaggagaatggtgtgaacccaggaggcagagcttgcagtgagccgagattgcaccactgcactccagcctgggcgacagagcgagactccgtctcaaaaaaaaaaaaaagaaaagaaatctgcaatttactttttgttatctaactttgaaaagtggtttaatgcctcaacacatcagttattaattcaaagaatgataataatagcagcaacaaaaggtataagcaagagcagccgcctttactgaacacttactttgaactggccaagctgtttggtacttctcattttgcagatgtcattccagaaaaaagaagctgagacacaatgaagttaaatcaactgacttaggtcaaatgccttggatgtagagcccaaggcaggatttgtatacacatggcttttgaagggagtgctctcaaggcatggtaggaatgagatgtaggaaggtaaaagaggggaagggataggagctaagatttttcaagggaagttttgctctagtctgatccatggagatctccgaggataaacaggaaagcagagtttttcctgtcttaagacaagagaatggacttaaatatacctgttcctgttactgcgcatgtgggtgcccttgtgtgtgtgtgtgtgtgtgtgtgtgcgtgtgtgtgtgtgtagccttggctgtagttacccaaaagtaatcctgcagaaaatgtaaccgacgtgagcacttgggggtgcccacttctgggggatgaacacacccaccgggagaagggattccaagagacctgagcagaccccaacagcctctgctacagctgttggcccaaatcgcatatatagtaaggggaatatctgagattcaaacttcaatagttctgatgcctatatcagtgcctttaatgccccacctttttcaggcagtgccacatttgatacacacacataaatgtacaatatccccattatggcttaggttgatccattagcaaatattttttaaattaaatattaatgcaaactaggataagaaagtcaagcctatttggcacccttctttaatattttaatgaactgatacaaatattttttaattacatgcattatttaaatagtgtctgaggaacttggaggttgcttgaaaaggtctcccaaaattttaaatattccccactccatatcttatttagactaatatatttaaattcattctgtgaatgaagatttgctcagaacctcagtttgaacagtgtgctaatcaccatatgttccaaatgagtcactctgaatttctgaagaattgttatatatctttagttttcattttatcagagataaaaccataaaggcaagaaaaatttgatgttaggaagcagttgatgagccaactgcctcccaaaggaaaacaatgccatgaaactacaatctataaaacaaacaaggccgggcgtggtggctcatgcctgtaatcccagcatcttgggaggctgaggtgggtggatcatttgaggtcatgagttcgagatcagcctggccaacttggtgaaactccgtctctactaaaaatccaaaaacaaaacaaaaaaaaagccaggcatggtagtaggtgtctgtaatcccagctacttgggaggctgaggcaggagaatcacttgaacccaggaggcagaggttgcactcaaccacgatcataccactgcactccaggctgggtgatacagcgagatcctgtctcaaataaaataaaataaacataaataaacaacacaaaagcatggcttgatgcctgccatctagcactgcacaaggagttaccaactttgttctaaagatagcatgacttattgcaataacacaaacactgtgtataagaaatgagacaaactctaaatggaaattgctcgccagagcactcagagcctttgttcatccattttcatccttctcccaatccagcttctttgccatttacatgtagatacacaggggaatttccatgtcctccacttatcttggttaccgctttttttctccttatctttcctattttgaatgccagcctcacagctatcaactttcaaataagtagccaagaggtctgaatacttggagtaaatagaatgtttgattggacaacattgtgtatgcatttcactgagtaaaatgctagtctggatacctgcctatgataaggccaccgttccctattaatatgaagcaacaattggttgagcaggggagaattaacatggccaaacatgttatatagtagacagcacctctaactggtcacatatttaagccacacaatggcaaatggggaaataaggtatatggctttggggtaaaggcaagtatgaggcagagaccaatccctggaagtattttctttgaaaagggaatccttcagagagtgaggcacctcatttctattttaaactatagccagaaacatttctcctaaatgagaaatttgccctagggattcctgatgtttgtcagaaaccgctgtaaatttattttcattcactggagagaagagaagggaggtaacatttatgacatatgcttgtgcttttcatctgttatttaattttcacaagtttttcaggataaaatagtatccttattttgttgataagagaattgagatttagacaaattaaaaataaaacgaaaagaaaagacaaattatagcatgtaaaccaagggacagatcttgaggtaaaatccagaccttttggacctgatgttcatgttctttccattcttccatgcaccctagggcttaatacatcaactcggaaatgtaattgagaggaggctacaaggagacaccattgtttgggattaaacaaaagcaggctgttttgtttactgtaagattcctcaacacttttaaaatgctgaagtatattttgagcttctgggaagggcctacaggacaatgtgtccaaaattttatgaccatagagtcctctccccctggaagcattgcctgactttgaaattctactgaaaatattttagatactactgttgctccagtagtgctatactagagaagagaaaggcaagggctagaatggcttctgtttttatttcatagacttctgcatcgcctgaaatgttgtgagctcacattaatttgggaaataaaataagtatcatttacatgaataaagaataataccatgtacattcccaatagaatgtatttatagatacatgagaagaaatatgtgtgtactaaacataggtccatatctcataattattatgcaaaagcaaaagaggaaacatattcatgtactgtctgatgagtattataatgatacagcaatgaacagagttctgtaaaactgggcactgctcaaagtgaacagcatatgttaactcatttaattatcataataatcccctgaaacatatgtaattatctccatgtgtcagatgaggaacctgggacacaggtaagttaatttacgtctcaaaagtcctactagttacttacgtaaggaagtttgtggaagaacctgataccaagtgtttttctacaaaatttcatactacttatgactcccacataaacctattttgcaaggaattctggaagccttgtgaggacttctgaaacctacataaagactaattagggctcccaggatgttatttttgccttctttaactttccatccaccttatcctgctttttgcactttggttattgagaaatcaaaaaaatatatatatagttaataccaaaatatattttggaagaaacaaatactataaaatctgatttagcaatataaaagtaatattaattttaatgatttgcctgattcttattcattcatagacatttgatgagcatctactaagtaaagctgcaggaaatataagtataaattagaaactctttccaccttaaaaatatgcttgtgggtttactggagaagacaggtatttaaacatcagcagcttttttctaccagtggcaagatttatgttgactcctgaacagtctctcttgaggtcttccttgctaccagagacacatgcacacacacatctgtatgaggattagccaggtggggctgttaactcatcactggatcacagcacaactatccttcccccaaggttataactgtacccacaaccttataacttgcctatttttctgtgatgctttaatcatgcacagatgtatgattaggctataggcaaaactcatgcaaaacgtaataaaaggaaaaggagaatgaaactaaaacagaagtccctatcattattacagaacaaaaaaagagagagaaaatggactaaccgcttagactagattttggaaaataattgacagttatgaaaaagaataagaacaaatgcttacatagtgttaaccttgagccagacactgcaggtgctttatatattttgcctttttatcctcaagaactctataagataaatactattattatcttctttttactgatgaagaaactgagacacagaaaggataagcatggtgcccaacattacaaattgggtaagttcttgggcctgggttcaaattcagatgattgcgtcagaatcaacactctggaccaccaccaggacatctgtgatacaaagttgagtaagtactgaccaagtcacccctctttgctggcaactgcacctaatgttatacatatgtatgagaacatgtggtatttgcttttctgttcctgcattagtttgcttagaataatagcctccagctccatccatattgctccaaaggacaggatctcattttttcatggctgtatagtattccatattcacaaccaatctataaggtaaatcttatccccacttgttaataaaggaaaactaagaacagataactattattgactgggtttggatgaaaacacaaggctatttgaattcaacacagtgtgcttttagggggaaattgtctttggacttcagttctgtgaaagtacaagtcatatcttatttagtttagattctaaaaccatagcatgtttttattaatttttaattattaaggatacataatgggtgtatatatttatttgatattttgatacaggcatataatgtgtaatgattcaatcagggtaattggggcatctgttacctcaagcatttatcatttatttttgttaccaacattctaactccactcttttagttgttttaaaatatagaataaattattgtcgagtatagtcatcctcttgtgctatcaaacactagattttatttattccatctaaccatgtatttgtactcattaactatcccatagcatagagccccaaagcaaggattttttttctactgcaaattgcatcaatttgaattaaaagtgaactaatctaagtcccttttttattcaagaaaataaatctagtaatgaaagaggaaaattatatggatcatccctaaggacaagttttataaagtactttaaaaaaatgtatgagatgtacttaggattcctgcctagtaagccatttaatggaatctttgcactggtcttaaatgcgtctgtgtactgcttgaaacctctatcactcctttccttttaaatctgttcctcatattaaataattcttacctaggttttcacatgaatggtgcctaggcagatgcaagaagctgctgctagggaaataaaatggaaactcagaaatgaaggaagctgagaattgccaagcagccacagactcccactctatacccgcttcctcaccccaccctttcccacatgtcacatacacattccaattttcccttgcagaggaaatgaagcaaaacacatcaatggagtgaaatggtttgtccctaagaatcagaaaactaaagcttctcttagcaggtacaaaaaaaaatagcttttcttttagttaagtaagactcctaggcaaaacatcaaaatcctgggctcttgataacttttttgacatagaaatatttatagagatggctctttatcaatgattccagaaactgtttgacttgaagttgaaaaatgacttcaaggtataaaaatctggcattagcaccaagatgttgaccctgaattctcttatttttaaagattaaaaacaaactcataactcctcaatgttaaatatgttttctggacccaaaaatgtttttcattttacgttgataaattactatgttccaaagcggactgcttttctcctcctgggaaaaaaaaataatgtatgtttcatattgatattcttctctttttaaaattaacctccaaaaaaagctacataaacacatgccaaaaagtgacatgttcaaagaagaaatgaaaaatgtcactgtgtgtatataccaacctcccgtgtgtatacttttttaatgagatcattattttgcatactgttttgaaacttgttcttttaatttaagaaatatgttctgagtatcttttcaacacagttgtatttgccattctcatgggacttgtggtgaatagatgggagaatttatcaacatgcaaatgaaacaaggctcttgcccgagctgagtgaacttgggccaaggaagatgacactgattaggtgagagaggaaaccaagcttagaaggggcagaagtctgggacctaaaagaggcagccaggaaaccacattggttatgacagagccttttcaaggtcaggaagggaagttcatgacctggcaagcaacaactaggtagatgtaagagcacattaccgtgcccttatgaggagccagaactagtcattgtaagctaagcacttcatgtctattaaatatgtattctttacagacaatagtccatgagctggatccagctgaggattttatagaagaagtagaggctcagaaaagttaaataatttgcctgagatcacacagcttgttagagcagggattgtagtcagggtgttttcctcccaaaggcacagcatgttccatttcaacccacagacaagctttattctttatccagtgccctttttcacaatgtccctccttctgcctctgtacttgtacacatggttaaatataaattcatctcccagaaaatcttcaacaggtcttggtgcaaaagactcagggttcttcaatgagctcaatgcatgttaactggtaaatctcatggcttatgttcatggagtatgtgtatgtgtgtggagtgtgctagagtgtgcacccatgagtctagcatatgtttatacaaacatttgtgtacaaataggtatgtgtagatgcacatacaaaattataaacctcactgatcttaataaccattttctacatattttcaaaggcagggaattaggtctatgacaactaggtatcaaactttccaaaagctaataagagatgatttacggctaacacagacacaagagaagtacaaatgcaccaccattaaaaatatctgatgatggccaggtgcggtggctcacgcctgtaatcccagcactttgggaggccgaggcgggtggatcatgaggtcaggagatcgagaccatcctggataacatggtgaaaccctgtctctattaaaatacaaaaaaaaaaaattagccaggcatggtggtgggcgcctgtagtcccagctactcgggaggctgaggcaggagaatggcgtgaagccgggaggtggaggttgcagtgagtcaagatcgcgccgctgcactccagcctgggcgacagagttagactccgcctcaaaaaaaaaaaaaaaaagaaagaaagaaagaaagaaagaaagaaagaaagaaagaaagaaagaaagaaagaaagaaagaaagaaaaaaaaagaaaaaagtctgatgaataaatcttcatcactgaaattcagaatacaagtagaaaattccgtctatgtattggagtttgactatatttgtgaaggcacagtatataaacacctttcaggaattcatctgttgctttaagagaagtctgagagttttttcttaagcattttcaacataataaataaactactatttgaacacattttgctgggtcttctccctgagatattttacaaattatttggatcgatagtacaaaattgcagtcaaaccactaggaaatgggattttaagtcagtgccttagcctcatcacacatctggaggacaccattcccatacccttcctaccttgttcaattttaagtcttccatggtggtacctccatcgtctgagctacaatatttgtttttgcaaatttggagggttgtactaacagatactctctacatttcttgcttttttccctattctctcatttgccaccgagtctttcccttctctttgaacacgtctgtaagaatgatcttgcagtaatatacccaagaaaatgcctcctttatctaagtcaggaagagtgttcttttaaaactatgactgcgaatctcaaatgggcactcagcactgcccggcaatcttctcacatttgctcggtaaattcacttccccaggctctgataagactatatggtatttcctttctccttgaaatatcaattactccccaccacacaaatgcttttcacctcaccctacttcatactaactaagaagaaagcagttggacacaatatctctcaacttcccattatggatacaccaatatctaagcctatattctctgctttccctagcatataatgcagagacagagaggctttgctgcaactaaagccaactcctttacaatatcagggacctcagtggttttttccctatagcatccccagcacctagaagagtacccagcaggagctcagtaattataaattcaatgaatgaatgaatggatgaatgaatgaatatctatgactatgaaagattctatctgtcctaaacggggaggaggacaagcatcaggacaaacagttttagggtgatactcgacatctgtaggacatggatagataaccatatgtaaaacaaatgataataaataggagataatattcacccttgcctcatctactctgtctgtcttatctggcttcttacattgtatctaataattaatggttacattcataggatatattaatagagccagctaccttccattcatctctataagtcttaacaacagtgaccaatttacataagatgaaactgaagctcaaaggagtcaagtatgttacccaatgtcaactcttaaatgaaggaggtagggttcaagtctatggatttttttaaatggtaaagtccatactctctccactcagccacgctgtcaatcagcccctgagaccttcctgtaagtccgagttcaactgagtttcttagccaatccttcgggaaataggactacattctactgcagtctactggaaatgtcatgctgtcaaataatcccatcctaattgtgtcaggcatgaagtctaaatggccacagagataggcagagagacagggggacccctaatgggaactttatatctaccctctgtcttataggattggatcttgctttctgtgttcccagtcatgaattttaatcatgtaagaaaagacaagatcttttaagattacaacaggagcagatcttggtattgtgggatctgaaacacatatgatttggggaagtggggtctatgagaaaagaattaaaaaatcatatgtaaaattgggcatggaagttaacatttatttagactaggaatgggaaggggtccatgcatttgaaagtctctgtagcttaatcttcatttacttcaaacctaattctgcctctgatcatgatctagccctatctgggaggcaggaacacggtggttgagagcctttgttctccaggtgggcagcctgattttgaatcccgccttgaccacttctagttatatgatcttaggtgagtggctgaaatttcacaagcatatactttgtcatttgttaaattttcaaatacaactggatcataaaaactgttaatatgaatgatcatataaattcttgatcatagtgcctgacatatgctcaacaaagtgctcattaaggtgtgtttgatattattagcatctaatgccatcttcttgcttaccagctctggaacctctctatttgagactcccctactatattcatttgatacctcctgaatgcctgagcaccaggcacttaggatttgactctgtgtcttcccattatgtaccttcaacaacaagatctgggccctaactccctgctgaaccaaagcctggttcccagcctcactacaactgtgtcatcgcattttggcatacctattagttttataagaatccttgtttctgcctgtgtaccagtaaaccttccccattttcctgggcataatccaataaaactagaaaaaagtaatatcatgaaaagcattcacaatagatttttaagtgaagagctagaattcctataattgtggctaataaggttgtttttacagggatatgcaaaaatttaatactacaaatatgtaaaatggtgaggtcctcacctagaatataatgatcactctattatagataatgtaattattacaatatgtatgctaccaaatagcattgtgatttctaacaagtcaattaaccttcctgggcctcaatttactcataaaatgaggaagctggactacactttctatgattcttgctagttccaataaatatgtattagtacatatacctgggatattaatgtatcattcacatctcaacttggaatgtgcccaatttgaatatttccctttgaagctgataagtgagggagaaggaactactcaaaggataacaacattgtcttctttttttgtgtgtgaaattcacctttttacctctactgtcacaatattctcactatggcaagtgttcaaggaatattatttgacttttcgaaattccttctctagtaaagtcctattaagacaattaacattgctcctaaaagtgtaattataagtgtggtatatatcccagcttgttgaagcaacctggtaagaagaaatgaagactagacctgctcaccccatgtggaaggtagagggaaaacctagatcaatgaagagcagtgaagttttggcttgcgctcacacgaaagattgggccacaggcagttgtttcatataaaggaagtctgaaaataagtgttgaatccatgccctggtggtatctggtgcagagcaaagaggtgtcttggagtaggcagctatggtacagaaacaatatcagggcgtataaaagaaggtagaatcaggaactgtgtagagactttctatttgaacccttcaatggctttccagtaacaaacagtaagttctaaagtccttataatggccctgtaggatatgaccttggctctccctccattgctcctcccattaccctggcaagctcactctgcttcagctacactagcctgcctgtgctccttggatatatgaagcacacttctaaccagagtctcttgtatgtggcggttcctttgcctggaatgctcttatcccagactctctcatgtctcatgcactcatttaagtattttcaaacaagtcagttctttggaaaggctttctctgacaaccctttgataaataacaccctgtttctgtccccatgctatattttgtgcttgtctctattaaatattggattatatattcctatatattcctttatttatatttttgtcttgcttccccaatagtatatacatttctcaaactctgcaactgtgttcatatactgtgcttaggacaacatatggaccacaatagaggcacatgcagttagtgaatgaatgaatgaatgaatgaatgaatgaaatccactacaactactttgattcttatttttgtagcatttacggtttgtatctcaaaactcagcagatgaacttgcaagaatggaggctttatctgttctgcttatggctgaatccccactgtctagaacagtagctggcacttgggagttctcaatagataatcttaaatgttgtttaccatgaaaaagttcttgtactctagttttaagaacggaaatgaattgttctttgattttggtaacaagtcaccatcagaaccagttttaaactcaacccaatcaatcaatgacaattttgcattagtaaccatgctttggaaagcctaaaactctatatagcaacagcagtgtttggttttgagtgacagcatcttacaagcacagctctcacttgtttaccaagcaatgaagcaacttttggtttaaggcattgagctgtggtctctctctctctctctttttttttttgatggaaagatgatggttcttagctataatggcaaaagacaaataacttattataatcttatacagggttctaagcatatagaaataccaactatattaatccacaaaacaagcaggagagggaggtgctatgattattccaatttagtagacaaagaaactgaagtactgagggttggagtgcttatccaatgtctacagccaaggtgtattccagctgggattattattaaatccaattattttggcttcagagtctgtgttcttagtttctacattctatggcttccctatgagaactgaaacacacacttgttataattccaggagccagatttgtcttgatgattagtctactgacttaatcaaatgcttttcaaataattgtcataaacagtctggccggtgggggtgaatttcaaacagagaggtaagggcagacatctgtgggatggtggcaccaaagcaagcagttaggaaggtacagaatttagaatttaataatcggcatgttgaacaattaaggtaactgccctcgtgacttgtgtgtgtgtatatatttatatatgtatgtgtgtgtgtatacatacacacatacataagtacgtatgtgtgtgtgcgtgtgtttgtgtgtgtataaatatatgaatttctggtaagtcaagtgctatatcaaatatgtgtatatatatatatatatatatttggaaaggagatgaataattgttatttgaatgtggtaacaaatacccaccagaccagttttaaacccaacccaatcaatcagtgacatatatatttgttataggaccttggccttccaaaaattcatctgtggggtatctgaactggctaccagatggtaatggctcagtattactaaacgtattcagacaagtcatagaggtgaaaaacacctcaatttatggctaagtccctcagcctgatagttctttgtaatggcacctatttctaaccttaaagttatgccaaaaagcaacttcactatcactcggccctaaattcttggaccataagcagaataacaagagagctacaatttgaataagcattttatgaaacaggttatgtttgaagtttatcttctgaatataattcattagctttttctttgcagaaaagagttctgtcaataaccaatcatttttagttcatttcgtctctctgggactcagtttccttatctataagatgatcaatttgaaactggcagtttctgcaggatgttttgttctatgaaaccttgaaaaatcagagctacaattatgtaaattactgatatatcttctcttatttttccctcttcctcatttttctgggttcactatagtacctatgcttttactaatgtctctacatagagctagaagcaaaaaaaaaatgaatcagattcttaaatacaatttttttaatgggcatattctgtaagagaagttcatactgtgtatgacttttatgtatctctgtatgttttatcttacttgggaatatttatcttgtgcagtcacaatgaatgccttttggattggcgctacaataaagatattggaattaatctagactccttcatttacttccttgtgatcttaagcaagttattattctccctgaacttctagtttattcatctgcaaaatcaaaatatcactttcagtcttgcatgattgagatgataattccaaggcgaggcatatgcaacactttttttcatcctctttgtcttatacaggttctcaactaaggtaagctttcttccctcccttgtactctgttctcaataactagaaccatcagtgctccttcttgttttttacttgctgagaaaggttggggtgtgtgttttctgttgatgaccatcttcatcaagccttaaaacccaattgatgcttgtgttatgctttaattcaatgctggatgcacttacttcaaaatattactccaatatggatcatcttactgccttcatccatgcttcagtcaacccaatccatacatctcagaccttttcataaataacagtcgtcctggattcaaggtctcactttttctcagtagcatcttatgttgaatttcctcctttctccaatcaccagcccttctctgccccatctatttccagccatcccatttgtctcccaaagcaaaacagatcgactctcagtttgagaataaacatttctgtctattttcttttcaaattttaccccagatcccaactaaagtgtgcgcttgatttgactgaaatttaatgctgatttattcatgttacaagagtttgtttaatttataacatggtgcctttataatattattttactgtgtttagaagattacagtacacatgcttatgcttgttaaataatgtaagtgattgagagtatttcatgcatagaatgcgtccaagaaaggcttgtggaaaaccattaatggatgcctaatttaacactttctcccctttgcaaaattattagccattgcccttgatgttgtaatgcttaggaaatgaaaattatgtaataagatacggagtctgatggcctgagtttgaattccagttttatgacttactagctgagttaaccttgatccaaattcagtggactctataggtctaagttttcttatatctaaagcgtaagtgattacctatctcaaaggatttggtgaagattaaataagatatagccatactatactatattacatgaataatatatctatactatactctgtttaacacatgtctgacatataggtgataataaaaagatattaatattatttataattgttttattttatagctaaaaattaggattatgtcagtcaaataatagtctaaaatcacatgactaataataagtgaagctgtgattagaatccaagttaaataactttagatcctctgagtgtaatctctgaatatactaaatctttttcttccaatagttcccttttaggcattaatgttcttgaaataagaaaagatgaaccataagagaccctaaaggcggtatatgtattccctttatttcattactagatggtgtaaaaagattgtatgtttaagttttctaatataaagtatttttctctttcttaaactttacagtttacaaagacttctctgataccccaaaacacataagcgttggcatgccattgcactggaggaaccagaatgctgggagaattagaacaagactctgtgaatttcaactaagctatttgagatggaaatcagcccctcctagtcatctctggccccttggtccttattaagcaacatggtctgaacacgccatcagtgatgtttttgaatttgcccaacttactgacagatccagcacttccccacttctgtcaacagcacagcagaattaagaacttgggttctaaaaatccatctttgtgtatacagctaatattttgattaagcctcttgggggaagcttgtattacagtattacagatatttgctaaataaggtgagttgaataaatacaaaagacagcctagtccttaccctaagaaggacttagattaccagttgatttctttttgtctttttatcaaagataattaccaataacagtgacttttttcaagtcatgtgtgataatgcatttttgtgaaattttgcttttattaagggtggtagaaggatggttctttcttaattcagtaactgcttcagcataatttaatacatatttagatgaaaagtagatattttcacagcccagtgttacatatagagataatgaaattgctttgccattaaaattttgattcaatttctccctggaatgcattaacagaaaaccactttcatttttatagttgaaagaaaaaggcaatttactgttgtgaagtttcaggagtattccaaaccagcataattctggagcctcctaaactccccactaagtagagagagtctatgaatttaaaacactggccacaggtattgtgttttatccttagaaatctgcttctcattattattttcatgcctactgcactggcattaagattacttttcttcaaaagaaaatgtaataaatattaatggaattaccaaaaaagttaataaatgagttaataaataataatatgatgtgcttacttgttattgaaactcttaagtttcgagaaacggtatcatgaggatgcctgaaacagcagccccacacgtcaaattctagagctacaggaaaggatgtttctctattctcttgaaatacaatgaatatttccctgaggtatgatgaattatcctactatggaagagaaggaaagattagtctaaccattatactgtatatcaattccaaaataggccgctgatatctattttatggtaaatgatatgtgttacataaattctcaaattttaatttcctgttacactcattgaagttttgaaattgaaagttccatggagattatcaagcccagttttctcattttagaaaactagagaggtaaagtgacttaatccaaggttagagaaagcaagagagtagcagaggaggcataagcatttgtgctccaactactattttatattctcaggagaaagaatgttacctgctaactgtaactcttgggttataaacatatgacatggatctctgtgtagtattatgtattcatgaatatcacacatagatcagaacaggacccaagactcaaggacctaatccccagtcttctacaatgaaggagaactcaaatcacttaaagataagcaaatacaaataatttaaacttttatattaccaatttattttgaagtacatgtattctacacatagataaaagcaaaataacaactacattatacaaatgtcatattttatatgtccttcagaacaatatgcatatttcaaatataataatacaaaaaaactacattgtgaataccatgtatactataaaacagttgtaagtttacatgaggaggtttaatgatttagggaaaaagttcacaatcatcctcataaggctttaacctaggttcaagattttctacttaatattcaaattctttcataggacaattgagcagacagaaataagaaaggtgaaataaatcattatcttctgaacttagacatgcaaaatggtgcaggaggaaaggaactctcaggcgaaaagaaatcggaatgaaatgagcatcagtacttttttttaagaaagtttcagaagaaaactatgaagatgctagcttgataataaacattgcttatccttctattaattaaaattaggctgtaactgtagagtgcacacattctgatctatagacttaaactacacacaatcagctatatcaatctattcatttgttttttatctccagctagcaaagtatttagtcaaattaaatcttgttttaaagggcttctcactctaagatttactttggagatttgtcttatacagacttccaaatgaaaaacactattgctttctatctctgtcaacttttattcattaaatatttcttccttaatgtggttatcaacattttactatttataattacttcctaacaatcactggaaatcatatatgaagtttatattaaagtttctgagatagtgcattctctccatagtattagtccaagattgtcctggagaatgctgatattgtaaaacgtaaagtacaagagagaaattgttcatacaaatcagtacagctttgaattcaagcaataataaaaaggaaagacttcatagaggttagcagctcttagaggaaggaaacacaagttctcatttgggagagggaatatttgtgctcctgaaacaagcagaaccaatactagagtaggtgtcatcaccaaatccagattcaaagccttccacacaagagctgaaagaatggccacacaacatccatgaaatgagatgaaacaagtccctcaacagagctaggaattctgagattgttccatgaattgtcagtctcacagagaataaaaaccagttcattaaaatgggacatcccaatcacatttgccaactaaaataacacacacaaatgaacagagaagccaaaccaagttactggtttcatgagagtgtacaacatgaagtcagttttaaagagcaatggccacttctagattttagaacttatcctctttctagaactacagatatttccatcagagagggctaccaaaagcattctgcaacttattttaaaattaaataaacaaacccagctctccaccatcccccgcctcctgcgccctgcatcccccgccccatgagttataaatgtaggtttctggtaacctacatcagagtgacacacttattttaatttgatgtttgctatttgtaaatgcaatctcatttatgttacactgtggcagccattctctggagggctggattagttgtggatgtaaatacatttataatgtattttcctttttacttaagtttaaaatttgaagcaaggaaaatatctaaacataactacgtcaaacatcatctagagcttcttttaaaaattgctctgccaactttagagaaacaatgactggctgtatgcaaacacactctcaaaatgtgttctgagcagttagaaaattataatgtaaatttactcagattcccagagaaacatttaatttaggaaacaataaggacaaatacaaaatgtattgtttaaacaaagaggtgattgataaggagaacaggagaacaagcctctaatgaacataaacagcaatacttgaaaaacaattggctacctggaatctatgttaaagtctgttatatgagttagagtcttttccccttagaatctctgttagcatgtaaaataggtaacattataaacacttctccagaagactttatgaaaagcctgtcattctcaggctccaaccttagaccataagaaattatgtctatttatttccatttgatcaatgtatttgcatagcaagaaatgagtgatctcacaatatacccaaataaaatttgccgatacaataaaaggaggtactagataaaataatcaagcatcagtatggactaaatactctcaaaataagcaggtagatccattacaaacccttaattacttcagtttttgttctgacatttttgatccaaagtgtttctcctagttttaacattctcttgtgaaaacattactgcaacttacaaaaagtttatttcattaatctttcctaccctgaaaaacctggcttccttcatgtccatcccagagtaacatttctctgatctcatttcaggtgcctcttacattcacctaagacattttcattgcaaaacagagaatttttagaagtcactaaaaagcactcccttaccttctaaacctgcttcaatcagcccaaactgttccaataatttaacaaaaagcacaatgacgatcagaactgctatcatttcaagcccttccaagttcatggtcagctaggtcatggtccgaccacagccactgagaagtgctcctctgcctggctttctttgtaaagccattaaactacattaagaaggctactgctggagaaaggggaggaggagagcgtatgagagagagagagagagagagagagagagagagagagacagagagagagagagagacagagagagagagagagagagacagaggagagagagggagagagagagagaagggaaaagagactagatggagatggagaggctgagaaaaagggcgtgagtgacagaaaatgcattcatcctgtctgctgtagcagaggccagaagtagcagccggataaagtcgggcctgtcggaattatcggcttcctcattatcactcttgcacagagagacagccacgcatgaagtcgcggcgcagatcacccgaggacccaggaggtcaccaggaacgtcccgaggaaacatgaggcccggcgcggaggagatggctctgcgccccgggactctgcgcgccgcgccgccgccaccagtggctttgttgggccggccagttgccttggaaacaagagaacccaaggaagggctggactcctgctgcagacagggagcagagcaccgcaccttgaaatacggagaaaaacctgaaaacgctgagaggtggagtgacaacttgcattcagctgtttcagaaacattgttgaccagtaaggaaaatccaaatgtgtattttgtcccaactagctgagtgcagattgcaacgaggcttaagggagtccttcaatattgactttctttcccatgagtcaccttatccgaaagctcagtcactgagcactaatattctggtttgagtagtaactatcatatctttttgaagcatgggaataataaactaataagtattcatcatatttgcatagtatcttagagtttagcagctacctcctctgcactacttcataccattcaatacaccaaaatatatacagtatttaatgtgtccttctatcctttataaataatgatgtaagtaaatttggagccaggaaaagtttgagaataaaaaaaaaaaatctgaaaaaaagcggaagtttttgtctctctcttgcacaaactgtttcatctttttctttcctcctaacactgcccaaatagattagctccacaatgaaatacagaatttaaaaaaactacaagagagagacagcatcttagaaagccaattaaagtctcctatttcatagatgaacaagctgaggactgaagagagcaaaagaaatgaggcaaaaaggcagagcaggatagaatgaaggcatccttcacttggggttggcttttgaggcagtggagtataagtttagaatataaactccagggacagactgctgggatctcttactagctgtgtgaccttaggtaagttacttaacatctcagtgtcttaatgtcctcatctatgaagagaggcataatagcacctagctcatcactctgttgagggaattaatgagtgacacttttagaaaagagtgagtgctcaatcactaccacctcgggtgcttttcacaagtgtctccatgctctactcagactttgctgggttgccagaggaatcaatctggaggaagtgcagtcctcctcttatcattctcttaatcagaaaccttccatggctccctatttgcctacagaacaaagttgaagctcctttgaagagcatccttttctctccgtgatccggtacctccttgaggattgcacctcagtggtcttactcctgtcgatacactctacctgacagctcagcttccttcacccaaactcattctgggcttttccatttctaggactttgctaaaattgctctatctatttagaaaaaccttcttacaccatctctgcctgtcaagctcttaaaactctttcatggaaacttcaaccagaattggatcaaatctctcttttttgtgtttttacggtacttttcctacttatgatgtattatatgatagccatatgggtatacattctctccattaaagggtaggctgccagagggcagagatcatgccttgctaatctagatagtcactactgtgcctccatggagggcacttcttacttcatagatgtttgctggataataaaagtcatcaatgattaggtgattactacacaccagatgctttaatgcattgctccttcctagacattctaaaagtagggatgatgatttgcaggtgtaacactagcctcagagaacctaagtagcaggctcaaggtcacacagctggtgaatgacggaaccaagcttcaaattctgatgtgtttaatgcaaaacccattacttcatcccattatccaacagggctttaaatgaattaaaaatccaaatattggcacaagtgcttatcagcatggggtgaaggttatacccaaaatgatcccccacactgttttgtgacattcttttttttgagagagagagacagggttttgctctgtagcccaggcttgagagcagtggtgtgatcacagctcactacagccttaacctccagagctcaagtgatcttcctgtctcagcctcccaaagtgctgggattacatgcatgggctaccgcaactggctgacacactgttttagccattaactccggtaactttggaacatgaaaagcatccaaactagtagttaattaaactcaaggatctttcttcctcctcattcacaggattaatattacttaaacacacaccacctcggaactcaaaagggagttgtttttctagtacagtgaactctgcagagcccttcagcttgccttatatatgaatgtccatagtcaagtgctttgtgttcacatttaaagttgatgacctggggctgagaaacatatgtaggcaggaactttttttttttttcttgagatggtgtttcactcttgttgcccacattggagtgcaatggtgagcgatctcggctcaccgcaacctccgtctcctgggttcaagcaattctcctgcctcagcctcctgagtagctgggattacaggcatgcaccaccacacccagctaattttgtatttttagtagagacggggtttctccatgttggtgaggctggttttgaactcccgacatcaggtgatatgcccaccttggacccccaaagtcctgggattacaggcgtgagcaactgtgcctggcaaccgtgccgggccggcaggaactattgaagagcatcagagtgagagtccttccacttggtctggatgtcaaaattacgggttcctttgctgttatgtttttcatcccaaggcctgagggtttttctttttttaaatgtttatgtcattagctccagcctttgtatttccctctcttgcagtgcttatccccatatcttcccatgagtaagtgacttgacttaggtcttagttccaaaattcctatcacagagaggccctttctaactgtactatatagaaaaacctccctcacctggccctggaatcactaccctctgaaccagtgttattttcctccaaagcattgtcaccacctggcatgtatatttgtttattaagtgtctccttctgccagaattgctacaatataaactcctacccatgagggtagagatttttgtttgtcttgttcaatataatatcctcaatcccagaatggtgcctggtgaataagagggagtgagtggttgttgaatgaataatctgattgatattctcacctaaaaagctacctgctctctcactgatctggcagagcccaatttcctgttaccagcatgcctcctctgcctggggagcctgagagatttccatactttttttttaggaagtcctattcctactgcttctttttaaggtgagccatgagcactgcatgctcacacatattagctgtgctctatcttcagcatttaatgtgaatatgatttgtggttcctgcccacgtgaacaatgaaagcaatacaaggaaggcagccaagaaggttgccctgcccaaaatatcttaaaatcactggtgtggatgataagtaccttggatagcatccactctcatcccttcattttcagctaaaagaacactgcagtctaaataagtaaagttacttaactacatatgcaactcttaccttcaagtcgcagcgtggattcaaactaaaatattaatccaatatattttcttcctgtagggccttgaattcccttttaaaagagaaatattaagagcatccaacagaaagaggaaacctaaatactggctccaaatctttgtcctcgtttggattacttaaacttgctaagctttggtttgctggtcttcaaaatgaggccaatatccctccttcagggaagtgttgtgaggattaggtgcaataatatttctaaatgatacttaatctccgtggagcacatacgttttcaagcagtgggcctaacacatagaatcttcctttctaaatacccctctttgaggaagagaggggtttacatttccatcttatggatgaggaaacaaaggcttgtgaaggactagtcaatttcccccacatcccaaagcatctgaagccagtggggctgatagctgcttgctgatggtcataacattttcccatgtgtctcatgtaacagtggccaggaatacccaaagcattcaatgaaacaaacatcaccagcataagtaacccaacacttgatagtgactttttaaaagatttctcgccctttctgcattaatgttagatacaagaaagttctgtgcccctgccgtgtgagtgtgtgtgtgtgtgtgtgtgtgtgtgtagcagataagtatgaagcggcagtgagagaaaagggacactgttgtgacagtttgccaaaattttcttctctgcaatgcattctcacgtaactactgaggagggtgagaggctgtttcaggcgcccccatttaaagaagtttcttcaaagcaattttggggagtccttcagctcaggctctactgctgcatgaaggttatctcttgcctgtccccagaaaaatgaacgtgcttagagacactcttacttttgcacttcagagcgtacccctaaagtgcagtttattcaaaatcaccagttaactcacagtaatgaacccatttctgctttgattccagcaatatggcttttggaagaaaaataatgtttataaaatgaaagattagtttgccctttgatgaactgaggcagggaacaaagggattttggcacgttatgtctctctagattccaggctgggaaggctttaaagagaagaagagaaagggggcgaactttctctacgctttcaccacagagtcccagtgagttggccttctcaagacctaaccttcattcagtttgtttctgattgttcatctttcattcaattgctaaagttgtggtccaggtactatataagccagtatgagtaataaaaagatgaatacccatttttccatgagctgattattaagtatttcatacctgtacaaaaatatcacttgtagcccataaatatatctatgtactcacaaaattaaaaattaaaaaaatatatccttagtcttcactagcttaaaatctattaaaaacaaaattcagatgataatagctcatgtgtgtagaataatcactatctgagagactagcacacggagcactttatatggattatttcactgtatcctctgtaaaccctatgaggcagctactaatgctatctccattttgcaaggggaaattgaggaatggaggcctcattgggttataccaggaaatatccagctcgggattgaaacccaagtctgactccagtgatcaagagataatattttagatgccattgaaaacacctgaaattcaaagcagcatctggtaaaagtctttaagaaagtatggaaagtaccatgagatcagggaaagctgacaggctctaatggtagtggcaggtaggggaatcgaactaagatcagctttatagagatcacgttgtgctgatactatgtagatactaggtggtatttttcttttcataggaaaggcaatgtatattacatgaccaatggagaagaaaactagtcttgccagatattttttggtttttttgagacaaggccttgctttttcacctaggatggaatgcagtggcccgatctcagctcattgcaacttccaccgcctcccaggttcaagcagttctcctgtctcagcctcccgagtagctgggagtgcaggcgtgcatcaccacaaccagctaatttttgtatttttagtagagatggagtttcaccatttctagggctaggctggtcttgaactcctgacctcatgtgatccgtccgcctctgcctcccaaagtgctgggactacaggtgtaagccaccacacccagccttgccagagaatttacccagagcctgaaagaacagtcaaagcccatctcaaatcacttgcccaggtgctcctggaaagtttcttcccctcatttttcagaccatctcctattctggtgcgcaaaatcagcatcagtgacctgcctttaacttcctttggcacttacttgatccaagagaagcctggctgaatcttaggattgagtgaatagaaagcaaatttgacccttcaaaatgaactgaaagaaaacgagcagaaggcaaaggcatcacataataaatgtatttctttcttcttcttttttttctttttttgagacggaatctcactctgttgcccaggctggagtgcagtggcgcgatttcgggtcattgcaagctccgcctccgaggttcaagccattctcctgcctcagcctcccgagtagctgggactacaggcacgtgcacgacgtcggctaattttttgtattttaatagagacggggtttcaccatgttagccaggacggtctggatcgcctaacctcgtgatccgcccgcctcgacctcccaaagtgctgggattacaggagtgagccactatgcctggtctgagaaatgcatttcaataataatgtgaaaagacaatgagccgcatttatggcagaggcagtacaatgcagaggttaagagtatgcttgggtttaaatccccactttgtttctttagagccttgtgactttgggcaaattgctgagataagtcatacaaagcacttagaacagagactgtcactgtgtaaatgctcaataaatagtagctgttattgttatttattgagctcttgctacacatcaagtactgttctaattgaattatcttaatatgtccatataacaaactcaatgaaccaagtactattattattcctagccactatatggataagaaggactagggcatctgcaattgaggtggaattctaaggaaaacacattgcttatacccacccatgaagctgaccaccatcttcaccacgagtaatataggaagaaattataaacttataatggcttggtttttaaattgttcttcttaaaaatgatggaaaccacctgttatcccagcactttgggaggcctaggtgggcggatcatgaggtcaagagatcgagaccatcctggccaacatggtgaaaccccatctctactaaaaatacaaaaattaactgggtgtgatggtgcgtgcctgtagtcccagctacttgggaggctgaggcgggagaatcgcttgaacccaggagatggaggttgcagtgagccgagatcatgccactgcactccagtctggtgtcagggcaagactctgtctcaaaaaaaagaaaaaaaatgtaaaaagcctgaaaataactatcttgaacactgatatttgaggacatctttgtcaccttccattctgaaacatttcacaagatgaacagatgcagtgaggtgttggcatgacatcagattacagattctactcaaattcaagtggggtttcaaagggtcctatcatcatttccttgaggaaacccaccttcaagggcatatttgactgcttcataagtctcatcagccccatgatctatgaatcacaatgtagttctagactagtctagtcttatttggtctagttccatgactagacaatatccttaatgatgaaggatcaacaccacacccagacttcaccacccatccttgtcctaagaataaatagcaaacacaagctgctcagtgggtaaaggtagttaaatggaggaacaatagacagggactcaaacaactcatttgagctgtacattaccacattcttaaaggactgaagacaaatgggaggaaaggaattggtagcaagagtgtccagcactggcaagagagaacagagaactaagctgttatacatatgtattgactcgtggtgctcaaactgttatgtgcatcagcattaactagaaagctccctaaaaaggaatcctcagacctttcccagagattctcatttcataggtcttaggtagagaccctggatctccatttttctcaaaagttctaatgattcttatgcaggacttctctggaccacactgtgagaaacactgcattaatctgctcaaacaccctcacccatgtaaggaacacattctcccagctcttcaaaactagctgagagtcacaccttttacaaacttgacatggttaagaatagacgggggttccttcggtttctcatacttctctggaaagttttttcttcgaataaaagtaaggcattttaaacagattgggaatagacacaagtttctattccatatttaaagggttttgtttgtttgtttttattcaggtcattcatttcctgcattcatgacaactttctctcatcaatgagctttagataccaactttagtagagacagaggactgtgaatgatcccacacttttctgcatcacttcataacctagctcccatctttgatctgtccctggagaatccgtctttcagctccaaatgtaatcacttaagtgaagggcagaactgatgtgcagccatcttaatagccaagctaagtgaagtaaatagaattgatagatacaaatgttcagaagtgtgaagctgatttagataaagtagatatttcagtttgagatctaataaaaagcaaaacagcagccacatggagccctttcccattactccctgggtctaatctttatctaaatcaatactataaaagtaacaaaagacacaaagttgtctgatgcataattcacttattatgaactcatgtaagatgcaaataattgaaacaggattatttatgtgatcattaaacccaagggtaatttcaacagatttttagccctggttaataaaaatcttagttgtggatacatatttagccagatttccttccaaatatcgtctcctccaacaaattattcctcattacagctgacatgctgtacttcctcactgtaatagagtataaataattgtttatcctattattttattgcaccaaagaaatataaaatgtaaaaagcaatatacaacaatctccttgacaattattcatgtttatatgctgtagtttaattactaacaattctaactactcacttgttattaactttgattttaaacacaaatatttcaaataaaaaacctatgataaccaagttaaactagaatcgaattatgaatactaattaagtatatattttatttgaaaaacacacaggacaccgttagtagaaccacactgaaaagaaaaattatcctcaatgcaatggaaatgtaacccattaaataatacaaagtggcctcaaagaattaaagattagcttgtatggataactgagagcatgctatgttaagtttattatgagcagactaaaactctcttgaagggtcatcaaaacaagccagtcaagcctgacctgctggtttgataactcaggatggcacctctctgaactacggtattgtttcacagttttctactgctgcatagcacatcatcccaaattgagtgacttagaacaacacaaatttattatttcacagtttctgtggataaggagtctgggtacaggttagcagagtgctctattcaggcttaaatcaagatgtaggctcgggctgtgatcatatctgaagctctgtgtcctaagatcacagtttgttgaaaggattcacttccttgtagttttatgactgagttcccctgctttcttgctagctgttggacagggaccactctcatctcctagacattgctcttggtgccgtgttctgtctgcaatgtggtaggttgctctttcaatgctagcaagaaatgtcttccatgcttcaaatttctctgacctcttttcagggcttggccgattaggtcaggctcacttgggattgcatccctttggattaactcaaagtcaactgattaggaaccttagttacagctacaaaatcttttcacccatatagggtaccaaaattatggtagcaatatcctatcatagtaacaaatccaattcacacttgaaggaaagggattatatagggtgtgtacatcagggtcattttaggtgtgcaatcgtgaggactattctagaattctgcctaccacaacaggtttccactgtaactgctgagtggcatgctaggtgttctgtggttgtaggaggctgaaggatatttttttttatctcatgcatttttcaaactatatctgaggggaggctcagcatagaactactggacatttggccactgaatgcacagaagccaacagaaagatgtaaagtcctggagtgtaagctctctattaacaagtcatggtaacaaggaaaggagaatggccagaaaatgccaatgcaaaactctggctacctagtgtggttagactatatgttgaatagctggcttcatccactgaaatatataaggcagaaagaactatctagaaaaggataaagagtaccatatttgggaccttaacactgtagcttggggctccatttcttttagagcagattcttcttgtatttatagttttatttttatttttcctgcttcctgttgctctgctctggctatgtttccactacagttatggctgatcttatgatctattcacttcctcaagttagatgatagtgaaatactgcctggacacaaatcctaactggatacttcactggctacacagctttgggtaaataccatctttcagtctcagttacattacctatacaacacagatagtagtaacatctcagagttgttaagttgaaatacagttgacccttgaacgacataggttagagccccacagaccaacttatacacagacttctatctctgccacctctgagacagcaagaccaacttctcttccttctccctcctcagcctactcaatgtgaagatgacgaagatgaaagcctttatgatgatctacttccacttaataaatggtaagcatagtctctcttctttatgatttttttaattttttttactagcttgctttcttgtaagaattcagcatataatacatatacaacgcatgtgttaatccactgtttgtaatagatcaggcttctggtcaacagtaggctatcaatacctcaatttttggacagctaaaagttatacacagattttcaactgtgggggggccagtgcccttacctctgcattatttaaaggtcaactgcccttaaaatacatcaagctcccagacagtaccaaatcgacattaaataaatactattgttattgacataattagtacaaggtgggtgttatggttattttgctcccaaggtatacccagaatctagggccatgtctgatttatggcatccactcaacacatgactgtcacaattctgtgaagcctctcttcccttctgatctacccactgtataccttgttgtcaaagtgaaaggaacatgtaattccccagcttcgattttcagtggtattttgctggtatatttcattttgcagaatgaaatccgaagtcatggcaaggcattcaaaacccctaccaactttccaaggaactatccatcctcatttcctgaccgactgtgttcacactctgtgttcaggtcatgagaaactactgctgtaacccaaatgccagggtgattcctccaactgcttccttttccttctgagaaattcttacccatcatttaagaatcagcttaaatccttccacttgggtggaggctttcatgagcccatcttccaaagacaagattaaccccttcttctttctgctttgtaactatattcaactactatcctttcaagatttatgagcaggttgacatactatgtcctgtacaaaactatgaatcctggggaggaagggccatatctgatttatatttctctcctcagtacttatccatgtgcctgaaatatattagttgatcagtaaatgttgcagtaaatgaaggaggaatggaaaggaacaaagaaagaaaaaaatgaatggcatgctatctggagggtacaaggaagatttaagccaaaagcataaccctgcaacaaaaatcaccatgtctagaattcaaccattaaagatttaatttttcacattaagcatttcaggtgtcctgaaaataactcaaatggcagaaaactttaatcattaacaccatgatataacagattttcatttgtcacctttgcgcatgaaaagtgagaccactggcaacctgggaacttgaagctggttggcactaatgtgtgaaggctatgttgagagtcagtctgatagcaagtacagaagcttaaccagcaaaatagctagctagttgaactggaaaatccagagttattttaagacaatgcagaacgttccaggacaatccagcaaatcaccaatatgctaaatgatgcttcttcctcctgttttattttctatattaactgtttactgtattgaacattcaaatgcattgtcttgaaataattatgtacttgctaccaccctactgattgatacaggctgccaaattattaaaccaagtttacagaagtcagcttctgttctgggaataactggctcggggttttataatatatattccatttctttaggtacccaaaaatgcccagcatggtattctcaaaggtaacatcagtttgttcttatgagctgctctggccttcacatttcttaggtggccattcaggagatacttacaagacgatttagtgttcttgtgggatataaatgcttgccattagcaaagggaaaacttggcaactggtatggagtatcaagtatttcaaatagtttttactattgagttggattttatcaaactcttaacttacatgccaactatccccttttcatattttaaatccttaatgatttaacataaagtccatcagcacattttgattgatgaacatagaaatcatttttattaactaatatgaagttgtaaaaatatgtttactattctgtgtccaaaaacacctttaataatttctccatgggtctccttattttgagaaaaaaaggtaacaatttatggaggaaatcaaatgagcaaatatctatttaaataaactaaggatttttcaaggggttgttaacgataatgttgacaacttggtaaataagcaaacactaactcctattatacatataaggtgacaatgtgtgactataaagaatagaaagtgtgcatatttatcaagaaatcattgagaagctatattatggttataatggtgctggccttgcagaaacattttggagatcctcttttgagaactgatatggtttggctgtgtccccacccaaatctcatcttgaattcccacttgttgtgggagggacccggtgggaggtaattgaatcacaggagcaggtctttcccatgctgttctcatgatagtgaataagtcccaggagatctgatgtttttaaaaacaggagtcttcctgcacaagctctctaactcttgtctgctgccatgtgaggcgtgtctttcaccttccaccatgattgtgaggcctccccagccatgtggagctgtaagtccaataaacctctttattttgtaaattgcccagtcttgggtatgtctttaccagcagtgtgaaaacagactaatacaggaactgtctttaaatccgatttataaatcatcctgccctgcctgctctagctgacacctggctgccctcagactcaaactttccaaacctcttcaaatcacattttgatgatcactgatttacttcttgtaaacagctttaccaaagagggagacattttaaaaaagacaggtaaaatgacacgcaagtaacttagctattctcattagctcatgtaaaggtttgctagggaaaaagattgaaattaatggttagaataagccttttgtgttatcattaaatttcaattatgtacaatccttgcttacattacctggaataattggaagttcacagcatcattgtgagtcaaagcaatcctaataattaatttcttgctactcaaggtagaaagagcctctataattctactctatttggaaaaggtatcatagattcactattcacttaagccactgactttgaatgtttgaaatgggattttgaaaaggtcatttttctatatattttatcagttatttgcttttatattttttgagagttatgcattgtgtatataagtactgtgccactattgtaccaccaaatagtggaagcgaaaacgacacactactcgtgtttttttctttctaaaatcctgggtttttttgcagtgctttttgatatgtgtcttattaactgcaagtttatacatgaacttaggattcatttgttaaagagcctgagcatgaagagaagcttatttttctcttcatgagtgtaatcctgcagttttacaaggttagtaaaaaccctcttgggtttttatttttcctggacattagaaacatgaagagtctttcaatgagaaattatttgaaagggaattatatttaggccataaacaagctgtgaaaaaaactcaacataatccctcctgttaaaaaggttgaactccagaattttactaaattgataatggttgtacacacctgtgaagaatgaggaacaactctaagcagatgacctatcacgacaatttaaagagagaacttatgaaataagttggagaaaaatgcgctaaaatacattcaacgaggcgcgaattctagcctggcacttagggcctgctctatccacaggcaaaggaaaatggaaaagataaatctaaagggagccaagacctgtctgcttcccaaggtctaccaggcatggcttgatcatgctggctttgcttacagctttgatcatttggttgcaattgacaggtacttggacaaatcatgtctgcagtcagaatggacttaaggaataacaaatcaacagacacatgctatacacagagtgaaccttgccttcagccttgctgtgaacttatgctgcagttcttataactagttttccccttatgtctaaatccatagtttattcctagtacctgcctctcaattacccagaatcttttcctagaaactcttctaatgctaccaccactctgcagctctggaggctgccttctcctggacattccactgttatgtctaggcccatcatatcttgctgaattcctcagaaatttgaatcacctagtagcctgataaatatctatgcacactggatagtcctccccttgtgaaggtaaacttctttctacccatggtcaagaccatccagtatattctcctggccaccctacacagatgcacacaagacacacacacagatccaaacagacatcagtcaaaaacttttccacaacaatcagctcacttccacaaaaacagaatcctttagggtgtgtttttgttttacaaaactggtcgtgtcccactaatggatagcaaaatcaacttgatgagttcatgattagcagtatggaatagaaaagaaaaagaaaaaagaataggatagaactggtgagtgttttgcaaatagaaaaggcattattttgtgaaatccttttcagttatatttatttgtgtttttctatatgttcctggttatgataaaaaatgcacttcttactgtagttcatcatcaggaaagttttctaaaccatgtattagagcatttggagagaaaagcatcatttctacagttaaccttattgaaattgtaaatttgtgatctgaaacagattacacattaaaccagtacttcattacagacacaacaacaaacacaatttcatctgataagcaagttatcttcaaggaagcagataagcagagtttggagggaacaggcatctaaataattacattttgatggcacaatgaggaaataatctctgtgattgaatggtttaccaatttaggtgctctggcctgaaggtgcctggctaagcaggggctagcatactcgggcactgggaaacttgaaagagtgagtcaaggaaactatagagaagggcttggcataggtgagctccaagtgtataatcattctattgctaacaaattgtgttgggtagaactggttaagaacaatgatggtgagatcttatatgtgtttatgtgttagcattttttaaaggatttttctacctactatattgttttagtgaggcatcttagatgcaaaatgtaaggtgatgctcattctcaggatttgcaattaccctgtgagctttgcttgcctggccccagtctaggtcctgtacatgagatatgacagtattgattcctaggccggaagcggtggctcatgcctgtaatctcagcactttgggagaccaaggcgggtggatcacttgaggccaggaatttcagaccagcctggccaacatggcgaagccccatctctactaaaaagacaaaaattagctgggcatggtggtacgtgcctgtaatcccagctactctgaaggctgaggcaggaaaattgcttaaacccgagaggttgcaacaaactgagatggtgccactgtactcaagcctgggcaatagagcaagaatctgtcttaaaaaaaaaaaaaaaaaagaggaaagttagtcctacagaattttagctgaaaggtcatgaattgtggtaaatctgagtttaaacctttggcctcctgagttctggaaaaaatgcattttttaatctacttcaaaagacctcagtaagaacttattctgcatacatttgcaaagtaatgaactggcaagataaagagccatactatggttatttgttatgaaatgtttgttcagaatgaaagaatggcaaaatgcagccagcaaggtttcagccttgaatcctgcatttagtttgaggcacttccattccagaaagacaaagacaaattaaaaaccatttagagaatgataaaaagatgagtagggaaaagaaaggtttgatttatgaggctagattaaaggagataaatgcctattatgtggctaagtgacaaccagggaagataagaatctacagatattgggaagatgtaaatataggtaatagagaagacatctaagtgttctacaagatagaactagtaagaaaaacggaataaaatattaaatgggtagacaatacgaagaaggcttttggcaaaaggattaagtgggtagcaatacaacatggaagatggaggggtaggaggaggaagagggagaagaagggagaataaaagaacaggagtatgaggaagaagaaaatgaaggaagaaacaaggaaggaggaagggaaggaagaatgtgaagagagagaaggaaggagagaaggaaggcaggagggaggcagtgggagaagtggggaaggagggaaggaaggaaagaagggagggagggagagaggaaggaaggagggagggagaagaggagggaaggagaaaaagaagaagggaaggaaggaaaggaaggaaggagaaaggaaaaagcaaggaaggaagaaaggaaggagggaggaagggacagagggaaggaaggaaggaaaaaggtgggaaggagggagggagggagagagaaaaggagggaaagagaaatggtggaagggaaggaagagaaggaaaaaaggaaggaaggagggagggagggacagaggcaggggaggaaggaaggaagaaaggaaggaaaggagggagggaggaagaaaaggagggaaggagaaaaagaggaagggaaggaagaaaggaagaaggaaggaaggagggagggagggacagaaggaaggaaggaaggaaggaaggaaggaaggaaggaaatgagggactatgttttgtcccactgtatttaacagaaaatataagaaatagatttctggcagttctaaggcagaatgaacatctttccagaaacctgagccagctgaggagatggtatcaacaaccaacctcaggggaggaggccacaactaaatcagaaggagacagtaatgaggagctgaagtgggcttgcaaagccattactcctattaagtccagggcttgtgcacaggctacctgccaacttttggctagcctataacacataacagttactgtaattgaaactgaattataataccatcctggcacacattctcccctaaaaatacaacacataataatgctgttaaaataaggacatctggaaaacaatctagagtcccattgtttgtagctggcaccggccttctaaaggagtccttcctgcttcgttcttctactgtataaatggtgacatggtgaaaagggacacttcatttaagtgaatccgaagtttaatgtttgttgagaagcaactagatgccaaacactataccactcctgtttttgttaaataaccatctatgtgattcagattcatatccctgtcacaagattaaaaatctggtgtcaaagaagttaagtaatacattctaaatcacttaaaagataagagaaataaccagaaatagaattctagactgcttgtccttgtcctcaaaatatttccattatatctaacagcaatttgcccaaggcataacatttagtaaatgttcaattaatatgtgcataattgataattgtgcagaattgaattaaagggaattgatggtataactgaaatctaaaaagaatccctaatgacttctggtgatgaattgatgaagtgttgccaaattttcatcaaatgttgaagtatgtatgagtcaattatggccacactgaaaaatggcatctcttttgtaagtatatatatatatatatatgtatatatatatggaatacatgagatatgtatgcaggcatgtggtgtgtaataatcaaatgagatatctctaacctcaagcttttatcctttctttgtgttacatacaattcaattatgctcttagtcatttcaaatgtacaaattagtgttgactgtagccaccctgttgtgctatcaaatactagaccttactcactttatagaatgatattattgtatctattaaccatccccattctcccagccccagtacccttcttggactcttgtaaccattattctactctgtatcttcatgagttaaattgttttaatttttaactcccacaattaagtgtgaacatgcgaagtttgtctttctgtgcctggcttatttcacttaacataattacctccagtgtcatccatattgttgcaaatgagaggatctcaatcatttttatggctgagtagtactccattgtgttaatgtactacatttcctttatccatttgtttttgatagacacataagtagcttccgtatcttggatattgtgaatagtgctgcgaaaaatatgggagcgcagatatctctttgatatactattataacttcctttcctagcagtggaatttatggatcaaatgagttttagtttttttgaggaatcatcaaactgttctccataggggttgtactaatttacgttcctaccaatagtgtactagtgttcccttttctccatatccttgccagcatttgttactgaatgtcttttagataaaaaccattttaactggggtgagaaaatatctcattgtagttttgatttgcatttctctaatgaccagtgatgttgagcacttttcatatatctgtttggcaactataccttttcttttgagaaatatctactcaaatcttttgcccacttttaaggtgtattatcagatttttttcctatggagttgttttgagttccttatatattctggttattaatcctttgtctgatgcagtttgtacttacttttccccattctgtagaagtttcttcacctggttgactgttttctttgctgtgcagaaatattttaatttgatatgattccttttgtccatttttgctttggttgcctgtgtttgtggtatattccacaagaaatctttgcctattctaatgtcctggggaattttctcaacattttctgttagtagtttcaaagtttgaagtctcagatttaagtatttaatccatttttatttgattgttgtatattgtgtaagatagaggtctagttccattcttctgcatatggatatccagctttcccagcaccatttatggaaaaggctctcctttcatcaatgtatgttcttggcccctttgtcaaaaaatgagttgagtgtagatgtaagaatttgtttctgggttgtctattctgttccattgctctatctgtctgtttttatgccagtgccttactgtttttattactatagctctgaaacataatttaaagtcaggtaatgtgattcctccagttttgttttgtttttttcttttactcaggattgctttggcttttctgggtcttttgtggttccacataaattttaggacagttttttctatgtctgtgaagactgccattggttattttgataggaattgcatcaaatccatggattgctttaggtagtatggacattttaataatattgttttttcaatctatgaacatggaatatatttccattttttatgttcttttcaatttcttgcatcagtgttttatggttttcattgtagagatctttcacttccttggttaattcctaggtatttgattttatttgcaactattataaatgggattattttctggatttatttttcagattgctcactgttgacatatagaaatactatggatttttatattgactttgtatcctgcaactcacataatatgagtttggaagtattccctcctcctaatttttcagaatagtttgagtaggactggtgttaattcttctttaaatgtttgatagagttcagcagcgaagccagtgggtcctgggtttttttcttggatattttttattacatctttgatcttggtacttgtaattggcctgctaaggttttgggtttctttgtggttcaatctagtaggatgtatgtgtctgtgaacttacctacttattttaggttttccaatttattggtatatagttgctcatagtagcctctagtcatcctttgaatttctgaatcatcagttataatgactcatttttcatctctgattttatttatttggttttctctcttttttgcttcattagtctgtctaaagttctgtcaattttatttatcttttcaagatacaaactttatgtttcattgatcttttttactgttttctttgttttcttttcatttatttctgctctgatctttattacttcttctactaactttgggtttggtttgctcttgctcttctagctctttaagatgctttgctggattgtttatttgaaatttttctactttcttgatgtgggcacttacggccataaattttcctcttaagactccttttgctatatctcataggtttttacatgttgtgttttcactatcatttgtttcaagaaatttcttaaatttccttcttaatttctttattgacacacttgtcattcagaagcctgttgtttaatttctatgtgtttgtatagttttcaaaattcctcttgttactgatttttagttttattctattgtggtcaaagatgatacttgatataatttcaattgttttgaatttttacagacgtgtttgtggcctaacatattgtctatccttgagaatccatgtgcttagaagaataatgtgtattctgcagctggtagagataatgttctgtaaatatctaaggttcatttagtctatggcagattaagtttgatgtttctttgttgattttctgtctagatgatcagttcaatgttaaaagtgagtgttgaagtctccagctattacattattgtattggggtatatctgccattttagctctaataacagttgctttatacatctgggtgctctagagttggatatacatatatatatatatatacatatacgcacacatatttgttatacccccttgctgaattgatctctttatctcttctttgttctttttatagtttttgtcttgaaatctattttgtctaactgtagccaatcctgctgttttttggtttccatttgcataaaacatcttttttcgtacctttttttttcagtctatatgtatctttacaggtgaagtgtgtatctttacaggtgaaatgtgtatcttgtagacaacagatcattgggtcttgtttttttgtttattttattttttttaattcagtcgtctactctgtcttttgattggataatttaatccatttacattcaaggttatcattgataaatagagacttacccctgccattttgttatgtgttttctggttgttttttcggttttctcttccttttttccttcctttctgtcttccttttagtgaaggtgtttttctctggtggtatgttttaatttcttgcttttaattttttgtgtgtctgttgtaagttttttgatttgaggttactatgagacttgcaaataataccttataacctattattttaaactgttgttaacactgattgcataagcaaacaaacaagcaaagagaaaataaaagttatgcattttaattcctcctctttttaaactttttgttgtttctgtttatatcttattattgtattgtgtcttaaaaagttgctgcagttatattatttgatagacttatcctttagtgcttttactcaatatatgagtagtttacacatgacgattacagtgatataatattctgtgttcttaatatgtttttctgtgtgcttactattaccagtgactttgtaacttcatatgatattttctcattaacatacttttctttcagattgaagaactccctttagcctttcttataggacatatgtggtgttgataacattcctcagcttttgtttttctgggaaggtctctatttttccttcatgattgaaatgtattttcaccagatttgctattctaggataaatttccttcagcactttaaacatgtcatgccaatctctcctgtcttttaagatttccactgagaagtctgatgccatacatattggagacctattgtatgttatttgtttctgttttcttgctgcttttaggatccttcctttatccttgacctttgggagtttgattattaaatgttttgaagtagtgttatttgaggtaattctgcttgatgttctataagcttcttgtacttgaataatatctttttctagtttgggaagttctctgttattatccatttgaatcaaatttctacccgtagctctctctctatatctcctcttcaaggccaataactcagatttgcccttttgaggctattttccagatcacgtaggcatcctttgttcttttttaattctttctgatgtttttgtcctatgactgaatattttcaaatagtctgtcttcaagctcactaattctttcttctgcttgatcaattctgctgttaagaaagtctgatgcattctttagtatgtcaattgcatttttcaactcaagaatttctgcttgattctagttaattatttcaatatatttgttaaatttatctaatagatttctgaattccttctctgggttatcttgaattaagttgtgtttcctcaagacagctattttgaaattgtcatctgaaaagacacataactctctctttccaggattggtaactggtgccttatttagttcgtttagtgaagtcatgttttcttttatggtcttgattcttatgggtattcattgctgtctgggcattcaacagttaggtatttattgtagtctttgtggttggcttgtttgtacctgtccttcagggaaaggatttcaaggtattcaaagagaccttggtgttgtgatctaaatttttggtcactgcagccacatctgcattagagggcatcccaagtccagtaatgctatggctcttgcagattcatggagatactgccttggtggtctcagataatttctggaagaattctctggattaccaggcagaggctcttcttctcttccctcaactttctctgaaacaaacagagtcactctttgtgtgctgaggtgcctggagctgggggtggagtgacacaagcacctctgtggctaccaccagttggactgtactgagtcagacccaaagacagtacagcactggtgccttatttactttgcccaaggcccacagtaaccactgcctggctacctgcctgtgttcactcatttctttagggcgccaccatcagcctgtggcaaatccagccaggcttatttccttcccttcagggcggcaagttccactggtcccagacaggtccagagatgacatccaggagccagggcctggagtcagaaacttcaggaatctacctggtgttctattctactgtgactgagctggcactcaagccacaaaacaaagcccttcctactcttctctgtcctttccacaaacagaggagtctcttccctaggccccaggccaatggtgagtaccacctggctaccccaggtgttcactcaaggccccaggctacttcagtcaccttgtggtaaatgctgctgggccatgactctccattcagggcagtgggctctagcccagtgcatgttcagaaatgaaaaaactgcatttcttgagagcaaagtatctttgccttctttggtatttaagttatcacaagtatatactaggcttcctcagtcttgcaaaagcaaaaaataaacctaacatctgaataatttcaataagtgctaagtctgtgtaaaacaatgcatgcacataataatgactttatgccttctacgattgtatgctgactgataaataatactgacaactaatatacaacatttaattatctacaatattaaaaaatactgttttatatacttccaagaggatacggaaaaacatacacagtttccatacttattgaacttatgactgtactggcaggcaggatatgaatgcatgaaaatataaaaataatcaagttttaaatacctatttgagattttcttttcaatagattttactctactaatatttatggaatacttactacacatcagagcttgtgttaggtatcagtatacaagaaataatacaatgaggttatttctttcaagaactccaccatctagaaggggaggaaaactttcaaacacacagttccaaaacatcatcagcagtacagagaacggtatatggtgctatggaattcagataaggaaagccttaattctgctgacagtgggtctgaaggtttatcaaggaaggcttcccaaaggaggcgagactcacattaggtcttgaagaatgagagtttcccaggccaaaaagaaagagcactccaagaagaggggatattacatacaataccatgcaggtagaaagattatcgaagagggtgacagactgggataattatgataagcattgttagcctaattactgttattcaatggggaagatgatataaaaacaacctaaaaatgtcaattttacattttttcaggtctaccagcttgtcagtataaattgagatgagctcaaggcctccttaagtagaatcttaacatggcaactaacatattaacaggtttcccgttcattaccgtaggataattcattaaaaaacaatgtattcagacttcataagcaaaagcataccttcctctttagtctagtatatctaattatatgaggactgctattaacattaaataaatcatctaatagataatttaaatgtgcagtagtgttcaaaagcaagtctactttttcaaaagtaatcataattgcagcagaggcatcacgaaatatttgattagtacaacgctaaggagtgagaatcatttcttacaaatgtacaattaaagaagttgtcaattatagcataaattgatcagcatgtatatgatacaaaaacatgttaacccgaataagtttagactatcagaactactgttgtgaaatattcctttgaagcattgactgtaaagaacacagtggaatcaaagttataagagctatagataataacatttatagttacagaattctgattatatgaattccatgaattaaacgttgcaccatccactttcatacaaaaacaaactggataaatgagtgatgacattcattttgccagtttacaaggtacagaaaagctttgtgtattaattctgtcaatgagaaaataataaataattttgtatttaatcctatttgaatttaattgaaaccctatagagcattccgcatgaatggttttcaacaaaaaagtgatgtccttaaagaataaggagcttaacttcctcttcaaacataagaagcagtgccattgaacttgcttactcttacctcaagtgaatgattacctcttgcaaatgaattttagcagaattttccaactccagcctcagttgtttctttttgctatttgttttgttgctttttgaaataaagcttctcttccttgtgctttgcccatcacttgtggcaggaatcaatggtaccctaaagataccgactcattggtgcagaaagctaaaacctgcccctttaaagcccaacctggatcaggaccgaaattaaataggattaactcctaatttgttcctgtgtcctactcttctattgactgtttcccagtccctaatagttgtccttgttcatgtgtaagacactgtgtcctcttcttccttagttaattgagtctttcgttttgactttctattctcaactttgactatttttttttgctctgtgggctaaaactaatatgcagatacagttttcccttcctgatctcaatagttcatagtttctattgagcagcttatactacatgtcacttcagagcaatttcctttaatgcttttatgaaatttccctcaagatgctttttaaaatttattttgtgtcttccttcccttcctttcttcccttgttctccctctctctcaatccttgcaaacacataaacacatatacttttactacattatcatgttcctgttgatattgtctctaggaatttcatatgcaagtatatattttgtatctcattttgacaacatgaaatctatgcacaaggagtcatctatttcctttgcccagaagctggggcccagtaaattgtattgagtaagcaaaattgtttggctcatttattcactagtttgctcattcattcaacagatatttattaagtgtttgatatgtgtcaggtcttatactaagtgctgaattcaataatcaatatcgtcacaagaaatattgccttacatatgtcctttttatggaacattctcttctaccttgtttttctagcaatttctgctcatctatcatgattcaacttaaatactaggttttccatgaaatgtcttctaatctttagacgtttatcagtttcttgtctttgctgtcatcctagaatatgggatgtttcatatttcacagtaattataaattcacatgtctgtttcctcccaattagactcactttgtgggaagagacatgatctcttccccagtacttgtaacaatgcatggcacatagtaggtccttagtcatttgtatacatgataataagagcatctatgtgtacaaaatttagtagaaagtcaacatccagcagtttaatagcattattcataatcaatcccaaaacaagtgattccaaggatctataaaattttaaaagctagtgttaatccagacaagtttatttacataaaatggaatcagaagcagcaaacttgattgccccgtcctctagaatataacctattcagaagcccattggaactttatattaacccctctgttgggaccagatagatactataagctaattaatatggtatattatacggaaattaacccaaggattctgatttttttttattgttagaagaatgaaacatccccaacaatttgcctatgcccattactatttttatggtgatgactccagatttacacctccaacagcattccaagtctcttatccatctcaatggataagacatgggaccagttatgtcccatggaataactcagagatattgtaaacattatctgtttaaaagagaactgtcaattctaccttcaaacctcccttcaatcccctctctgtaaatggcactgtccaacatctcaagtcagaaacacaggcacagcaaccctgacttggtcttgattccactttttctatctccactctcatccaatccttaacaagccctgctgtcttcatcccaaatagattaaacccttctctccatttcctgtaatgtattacatcagtggagagtcccatttcttcctgtgtttagtactgaaacaacttcatatctgtcctccttgtttctgatcctgctgtttccaattcaaagcgtttcttaaaatgtgtactatatcatactgttcctcaaaacaatccagtgacttccaattttatttagaataaaatttcaaattctttttatggtttatcaagtattacctgcctctctaattgttcttacaatgtttcagcttcaattattttctttgaactcctgtaatacaccaaggtctttaccagctcggagcctttgcacaagctgttctttcttcctgaaatgctgtttccctgaagtcctttcattattggttctttcttagcatttggacctctgttcatattatctggtcatgctcttgaaatagatgtcccttcaatcccacagaaacatgtaatttttccatttttgataatttgattgcttcttaattctcaacagaattggtgattttgctttaataatacttgtctttattcatgtcttacttgttttccctcctagagtataaattttttttaggcaagtactctgcctcccttgtaagtctttttacccccagggaccagtatggagtaaagcatctaaaaaaatgtgtgttgacaagcaaatgtgataaaataaaataacctaaaattaaaaaaaaatcagtaagccttaattgaacaactactttctgcacacagatatatatctataaattcatagacctttaatattcacaatagcactgtaaggtacgttgtatcattctcatttaattaatgtgaaaagcaagtttctcaaagtgttagtacaacttttggattttaatgtaagttcctgaatctaatcccagtcttttgtattttttcgttctatactcccaaagccataatttaatttaaatatagtttttacctcttgctgacatttaaccattaaatttttttccaccagttaaattaaaaagaaaaaaaaagtccatggcaatacatactggcattctgtctttgaaaacaaccaaaaaaaaatcaataaaaatcttctacataaacctgccgtaataaattaaagatgtgttaaaaggaaagaatggatgcttctgttgataaggatcatggccagtggccaaaaggcaatcttctgctgttctttaataactcggtgcaaaaacttcggaaatttttataccactactctatcatagcactttagtaatagattacaggaagtaataagcatgttattttcctaagtgtgctaaattgtgaaacaaagagttcttcatccaagtgcctactgtctgttgcaaagccagtttaagaaaccagctacaaaaactcatctttttttttaaatccaataatcattcatagaacacctaactggcaggcagtggcatggtggttgagagttaaagctcagaaatcaagggttcaagtctctcctccactctgtgccagctgtatgacactgaataaattattcctttttctcattattaaaatagagttaataataatgtctatctgatagggtcatggggggaataaaagggtgaaatgattaaaatgcccactatgtactaagatctccaaaaaaataatgttaactttggcttcagaatgatgtgttctgaggggcataagtttatgatactctgggtgttgagaatataagtattatggaagggagagcaaggtacccggcagagtgaatggagttaaataaccttaaggtcttttaggaacaagctattcccttaccattttttaaaatagctttttttgaggtacaatttgcacatcataaaatttacccacttaagtgtacaactgaatgatttttaggaaatttacagggttatataaccatcaccaaaatctaacatcagaatgttttcattgcctcaaaaagattcctcatgcttacttacagtaacagccgttcacacccccaccccaggcaaacactagtctacattctgtctctgtagatttgcctcttctggatattttatataaaatgtattatacagtatgtgatcttttgtgtgtgacttctttcagatcatataatgtgaaagtccaactctgtggtagcatgtctcagtttgcttctattgctacatcatgttccattctgtcaatataatacattgttttgatcaatcaccagttgacagactctggagttgtttctagattttgacttcgacaaatcatgctagtagaaacatttgtatacaagtctttttctacacctgtgttttcatttctcttcagtacattcccaggagctctccttttccattttataggaaagctctgcccctgaaagaccccagtgcaacttgttggaagtgggtagagttctaattccaactcaccagtaactactgagtagtcagctcacacaatttagtaggaaaaaaaaatacacatcagttcttgtctctgccctttttcccctaaatccccttgtgactttggaagataactggacctcatagcatctcggcatcttaacttgtgaaccaacggctgcaactagatgttctctgaactcttttaccttaaaaaacttataatgctcttagtaactaaaattttataaagaaatccagaaagcacaatcaatggattatctcccttgcccctgaaattttctgggcatagccagcacatagcacagtcacaaaaaaatatgataccgaaagcatttgaatattgtctattgcatgcagaatccaggatttaccagttgccaccttacacgtgcctgttttgctcttaaaattcttgcatatcactgtatttatctgtccacattttgctaaggcagttattttgttcagagttaagtgggcataaaacaaacattagtacaagaaaataggtggattgttttaataaacatttaaaaagtataaatccaagtaactactgttacctccaaaatagtcacctcactggatttacatttctttattctgatatcactcagagtatacttggatatttccctttggaactgccctccaaactagtggtatagccagtttctaaaattaattttcaaaccttattatgaaatgtttagcttgtagaaagaagtataaagaataatacaacaagcatgcatgtaccaatcacaaagctttaaaataattgattaccgatgctctggggtctattagtaccctctctactttctctgtccttatctccaataatttctgcacttaagcatgactgtcctcacacatatatttatatttttttgcatgtggatgttaccctatgtaatatatgatattgctttcctagtttgaatatttatataaatcgtatcaaaatggtatcaaactatatgtattatttatcagtttgctggattcactcaatatcatgtttggtgaatttatttacattgatacgtgagttctaattcgatattcaccttgtataacattaaatttttaataaaccacaattatttatcctatttcctattgatatatatttagatgatatctagtattttgctaccacaaacactttagctgtaaacattcttgtatctatcttctctgtgtacttactgaggggttccctagagttacctttacctagagtttcattacctaggaatgaaatttccagatactgagaaatgaacaccttcatttttactaattactactgcattttctccaaactacacccatttttattctattcatcaaggtataaagctcccatttgtgcacatctccccaaaactcagtactgttagacattttaattttcccagttgccaatttgattcttaaatatcaaatttaaccaacaatacatgactatgtcctctgaatatacctctgtgcttggttctgtgtggaatgcaaaacatgatatagtggcagtactactgaaattggaggaaccaaaaattgagccctcactcctgccgtctgtgaaaacctgagcaagttgtttaacctcttcaagtctcagtttcttcatctgtaatatgaagggatggacaggaaaaattttcaagctcctttcaccttccgtcctacttgactttatgatgctctctgggagcttataagactggaggagatgcaaaacacacatacgcaactttaacagcacacctaaatatacgtgtagaaggtactgggagaacacagcacacaggatctaaataggggtgaggaagaaactagaaaggtttcaccaagcagattgaatgagattcaccaagatggtatggatggaatggaggaaagacatttaaggagaggaaagagcatggcaggtggggtcgtaaaagaagacagtgaagggagaggggcaaggatagggaaaggggcaaggatatggagagaggcaaggatagggagaagggtgtggctggagcaaaaggtgtttaggtacatgctgggaagcggagaagatgaggccagttatattgtgatttttattatgtcaaactgtaataaatcttcattatgttatcgataacttgatttttaaacccctcaaagcaatgtggaatcaaatctgcaaataaggcagatagtcattttattttcactttaaaatgatgccatgaaaccaatttcttctgaggccaataggctgattctacagtcacttctcaagcagggctgttcagggggtttgagaaatggaaagaagcattgcagaaaaaagaatggagtctccttgcgtgcaagctttgaacagacatgctcctttggatttttgaattttatcaggtggtttaaaagattcattattttatagttatacttggtattgaaaattctcagaacctgatagaattttagtattcccacataaaatttttaaagtacaaacttctttttttattacttagaggaaaaaaaatgcctcctaagaggcttcaactggctatgctagaatggctgagaattttgaaaaagataattaatgtacctcattttgaataaactgatttattattggttataaacatggacctcacaggcaaaatacctggcttcaaatctggagtttcctattgtaaagtggaatattaatttaagcaagttatttaagatcagtttgttagcattaggattgcgtttggctacatgtaataaaatacctaaatcaatttcttccacccgtgtaagtgtcttgtttttcttatatcataggaagtcagaggcgggctgctgaagaccggctctatggtatcgctagtgacccatgctccttccactttctgctccaccattctggatatgtagcttttgtccttggcttcaagatagctcctttatcactaagcattgcttctggatttgaaaaagaaacaagggagaatgaaccaaaatccctccctttgtaagactttgtatttttaactcgggaggctgaggcaggagaatggcgtgaacccgggaggcgcagtttgcagtgagccaagatcgcaccactgcactccagcctgggcgaccaagcgagactccttctcaaaaaaaaaaaaaaaaaaaaaaagactttgtatttttatccagaagggtaccccactcaagagacttacttaagtcccactggctatacattgtgacatgggaacctggaaaaccattttttttaaatacattgctgagtgcatagtgcattgctatcctaaagaaaatcaggaatcttttagtaaatgatgtctagccaggcatactggcatgttcttgtagtccccgctactcaggaggctgaggcaggagaatggcttgaacttgggaaccaaaggttgcagtgagctgggattgcgccattgcactccagcctaggtgacagagtgagactctgcttcaaaaaaaaaacaaaaaacaaaaataataaacaaaagcaaaatgaaagtcatagcatatagtaataattcaataattcttactacccaaaggattatactaatgtgtaattaataatgttatatatataaatatatatattcctccaagcacacgttaatccttcgtggcccagatcaaataccacatctactaacacccttctctgattctgccactcagattctttttcttcatcacttaatcagttatatttgatgaaacacaaactaatctgacaagtaaacgaaaaaggatcgtattggaaagatacaaaactatagaattcagagtagagttagctcctgtaggttctataggaatctatagaaacatgggaacctaaataagtttcatgggggtaaacaccaccgagcttatgtttttagcttcttgagctaccatagcaggaagtaagtccttgattcctaccaggatccacaatgggattgctcttaaataggcaagtgctttgctgctagacagataaagcatgatcgctgtctactatagggtcacatgcaggtaagtggttgactttggtcaaatgacactatgatagctcagtgttatccaattgcagaaatgcctatttgttcactgaaattctgctgagtaactgtaataagaatgagaaggcaattgtttcagagaaaattgtgtgaataaatttagaagaagtaacacacggttttaattcatagaatgacaggtggaatgatacagtttagacgtaggatatggaaaggcacttactagcagcttacaaagcaaaacaactcgtcaacataatatgcaaattgaatatatttgaatagtagcatgacaaggttacaaccataccttaagagactttttctggtctgttaattgtataaagaagcagaaacaatttcctgaatataggtaatagacctaactatgggatctgaagtggggataaatagaaagggaataggtgggaaaattaggaagacatagtggggaaaaattgcaattggagattatatttaagaagcaaggatggaagctttcaagatctcctatgatttcaagcttgggtgaattggtgctgccagaaaagcaatggagaaacaaaaggcatgataggcagaggaagaagaaaagaagatgcatgtcatgtatgttgagtttgacatcccaatagaatatctctgagaaaatattcagaatttgaattacataactggtgcttaccaaagaacagggctgatggtatagaaaaccttttgcctttcttataattttctacagtttcctctactcttgtattctcatcaatcactcagttattttgcacatgtctagttctatgtaatttctacatttgtctgtataatgttatctttgtaaggtgacttatctctgtacaccataggcactattttccctactttacaagaggaaattgagtgtcagaaagagcctacttacttttcttcttactaacgaatgaaaaggcaatgttaatcatcatttttccccctaatcggtgagctatgaaaaaaatttggggtccatgcaaaatcatcattattatgtttaaactgtaactctacaaatttatgatctcctaaagctttccaagatgtagtatctctctcatctgttggcagatttttcaaatgaattcctactcaatgaaaaacagttcatttacattttaaaaaccttgtcagtattaaccagattattccttctaattattctttaggtctgatcttaggaaactatttgaagccatctgttatttaaattcaagtttattgcacgtaaaagaacagaacttgatttatgttatgtctgatttgttctgatatgtatagaataataacttggcaggatctcataaacagcagttatggtatagtacaaggctgtggtataactgccactgagattcattatcacacacatcttctaagggcatctaaagggcataaacatttcagaattctgtctgtaatcactatatgccctgctgatatgcaaccagaaaaacattctactctgaaaaaaaaaaaggtatatttctagttttcagaacacaaacttctcagatacacaaacaaggctgcagtttagtgtgagactcaatggccaagtatatttgtgggaactaaagcttcagtggaaagaagcattaggtggatttttcagatttgtctcaacatggccagctccgtatattacacagtctatattctatgtgcatagggcagataaaaggctctgtaatttgttaaatagtatcccaaaatattaacatcggtgggaacctcagaatgtgaccttattggaaaatatagggtatttgtggacaaaattagttttgtggatggatggatgaaagtgggccctaatttcaataaatggtgttccataagaccatgtgaaaacacacagcggaaggaaagctatatgacaatagagtcagattttggagtaagtgacaagccaaggaacactgaggattgccaacaactactagaagctaggaagagggagggaaggatttttccctagagctttcagagggaatatagccctgcagacacctttctttaagacttctgggcttcagaactatgacagagtatatttattttgttttacgccacccaattttttacagcagcctaggaaactaacactggttctaaatgacaaattgacaactctaattctgtttgcttcccttacataagcagagaaccacttaaggtgataccatctccacactcctcccatatccttggcaagtaattgtgcaaacatgtggataaaacacatgcattttgatatctttatgcaaaagtgtcttcaaataaaaaataatttaagagaaatgctaatcaagtttaatattacattttaaatcatttcctttcattaacaattcttattaccttcctaaattgcaaattattggcacccaagggacccaagggagtaagaagagtatgacatgatgacaatatctccttcttgaaacacttaaattaaatcataataacctgcaccttttgcttctttcttaccatttctgagatacatgaatcagttcttggcctcaagtctttggcaaagttttggtgggcttgtttacaaactacaaatgctttgtggtttctgctatcaccacagttttgatggccccaaatcctcaatcttctttatcattaatctgatttggagcctgatatcttcaactgctttccgtagttgactgacttgttacttcaaactgaacattgtgcagaatgcgagatctgcaatcaacaaggtgctatttggtaatattaatcacattcttttctttgtgcttgtgtcccctcttataaggactatttttcttttctgccccataccaataagaaacaaggatgcaacaacaacaatgacaacagacctaagtggaatcttggaagcatgcttgcaaagctcatgcttccccctgcataagctagctaagacaaggcacggggtaggaagaaaagagacaagattgtgactcaaaagtgtagatggaggattcaccaggacagacccaggaaggtgggatcctcaaaatgctagaaaaagaacatccatctcaagggtaaggagaggatgaaagagagacaaaagaatagattcatcccctaggggtaaaataattgaacgtcttgcatacatatataatatatacagcataggaaaaaaagttacttgtgactattcaaagctatttttatatcatttcctttaatcttcaaaaaactcattaataaacattgtcactattgctcactagaggaaattgaaagcttaaacatcatgcccaaggacacacagctactcactgctggagttagaacacacttcctctgacaataaatccactgtcctctttccaatttactttagtttataagccatgatttatttgcttttttctgtgctctgagaacttgataagtaaaattacaaatgccttacccaatcattcaaggaaaaaatgtattcaccccttattctctactaatttcatatatgaaacacctaatcgtgttgctaggctcacagcttgctatatcccctacaggaaagaaaaaaatcctgccacttacgtatatgcactttttttttcctctctgtgaaatgtccttttcctgatacaagtcctccctaaatgtcaatactcaaaacacatcattctctgtccattttcttagctaaggggcagtagtctaggtgaaggtgatttaagcctagagctaaggagccctaggtagtatcatgtgttttgaataaaaaactgttcatttttttttctgagccttgagttctccttccaaggactacttcctgctctccacttccataagaaaatgcttcagcctgtttggaaccagcaacataagaatagagaaagaaagggtttatgaaagatggacccaattatagcagtctgcattttcttataatactggtgacagcagcaaacttgtgaagctgcttttaagtctatgataaataggcttaaatagaaaaagttctgcaggtccaaagtcaataaaaatgtacataatgtacttggagttagatagtaaatgaggtcacaaatgcactgaaagtggaactattggaaagccacaggtatatttaggtagatactacttaaaaaaggaaagagagaaaaaaaataagaaaaagtgaggagagatgccagaggaaattcggaaagaaagaaatctatgtactatgtcaacctctacctttgacagggaaagcatctctttagggagttatacatccccatcttgcaagtttattatctctcctcagtcagtaaaatagcttctatcatgttgagcctgttctttattctccttgaaacaattcgacccatagaataaaaatgctgcttgtctatgaaagtctttaccaggatccatgagcccagggcatttccctagaagcagtctttctcaaatttattgtccatgagaattacctaggaatcacaaaatgtacactttctaacttcacccccagaaagtctcagggggagcttcaaacattcacatttttaaaggtcccctgtagattccgacgcaggctcttttttgccacacctgaaacttataggcaggaagaaacaaatgctcagagcccttcctatgtgccagttatagttccaagggctttctctgttctcctgtttttattaataactcattaaattatcacaaccacactccgaggtagatgctatgagacccattttaccaatactggtaaaagtcacagttagtaaataaacataattcaagtctctggtctgtctcattgctgtgccttttcactccatcacataggagtatgactgtctaggaaaataggttaacagaggagacaaagaactcaggaagcatacagttatgtgcacaagacatgtgctgacaaaggactataagtacagtcaataagaattagtggtggattttccaataaccacagaccctgataagtctataggaccaacctacaaaaggaagttgggtgttgggtgaaggactttattggaatccatctaatgtggactgtgagagaaacgttaagttgccaaggagaataaaagcttcatgtggcttgttcactatgggaaaggaaaggtcaagagaaaagtgggacttcagaggatgaggagtgaaataagccctggagccatctgtggatgtagcataagatccataagcacattatttcataggatttgcaatagccaaaggtcttggaaaccaaattgcaaagatcaggagagagttttaagaaacagtggggcagataaattatatttgttgaatctaaaaggagcagccaccaatccaaagaaaaaaatggaatttattgtattctgctaattctgagacagataggtatgatgcaagaaaaagaaaagatggaatgaaccaatcccagctgacctggcatattcccaggtactttcaagtacgttatcttattaaagcatcacaaaatccccgatatgtaggcagaataggcatcagtattccaaatttccagaaaaggaaattaaagtaacaatattgattactgttgttatttttaaaggtaattcttaaagtcatgttgttagtaaatgtaggatctgggactgcccacaggcattctgactcctatgttagtgctctcttcaaatattgacatacacagaggcatagatactacagaactcaagtctgacagaaagttctggtgtccactgcacctatgtattgtgtaggtgtgatggttttaaagatacatccatactgttttcgatattcttctcttccagtggtggagtttacttccccttgccttgagtgtgcattggacttagtgacttgcttctggacaacagaataatgcagaagtgatggaatgtcacttctgagtttaggttataaaaagactgtggcttctgtcttgggagggctctctcatactctctccttcttggatcttgctctgaaggaaaccagctgccatgcatgaggatactccagcagcttatggagaagtccatgtggtgaggaactggggtcggtccacaaccacctgagtgaacctgaaagtggatcttcccctcactcaagcattgagttgactgctggcccaaccaacagtttgtctgcaacttcatgggagatcctgactcagaagcactcaattaactcatgaaaacggtgagataaatttttgttgttttaagccactaagtttgaggtgatttgttacatagtaatggataactaatatagcagggaatcaaatgattttcacatcacaggcaattctgatttattaatcaaaccacatatttaaacagaaaaactttgtcctactccaatggaaacactttttaataaaaaaaaattagagctgtagaaataaggaagctttgactatcagggaaagcaaatggaggctgatggccagggtatgctccctgtcaaaagctggcctcctcaccaaatcacctcaacattgctgaacttgttcccattttctttattatattagcagagaatgcacaaattagagatttaattgagctaacaaccatctccttaaaaatatgaaatttctctgagggtgtttaaatgactagttatccactcattagttagaattaaagcccattacgctcctaataactcattgctaaaatggcctgtgttgagaaatggaggatttgatgaaggcaggtggcatggtatgatttcattttggagcactgtgggggcctgggtagaggtccacagtgggctgacactttggaaaggaatgatgaagtggagagaggcatcctgggtggagtggcacaatgccaaagcccaactcgggcagtgtaatatatatatttaagatatttaagatatcttaaatatatataaatatatatattttacactgcctgagtgtgtatatatataatatataatatatagaaatctgtaatatatattatatatatagaattatatatataatatatattatatataattctatatatataatatatattatatatataattctatatatataatatataatatatattcacatttgtatatatgtatatattctatagtgcctatattctatttatagtgcctataatagccttgtagccaagaataaagagccttttttctactttaaaattaacctggtactcttcatatcatgagttctaatgggccaccctctaaacctaaccaagattcgtaacagaatttgatgtggaaatgaatttcaaactcacactaacaaataggatttggaagacagcttatttgtaagctgggctaaagtctaaagcacagtgccttaatgtggaaaacttagactcacaaacaacttttttatggtgttatcttttaaattttaaggatctttatgcttcactcaaattacattctttagtacattgcttctcaaactttattgtgtatacaaatcacctggggaatcttgttaaaacatggattctgatgggactgaggattatgcctttctaaaaagctcccaggtgatgctgatgctgccgaaactcagaccacacgtacaacagcaaaactataacatacaatttaagagagcaactgtagattttccaagataaaaaagatgactcaatactgcacctcatggttttaggtttttgctacgatcaaaccaccaaatcaacatgatatttaatagtgaaattcatacttctagacttaaacctaacatcattttaattatttttaaatttaaattctggaacaccaatataatggttaagaatataggtttgaagttagaaacacatggattaaatgtttagttctgcaaccttctagctgtgtgacctgcgcaagtgaactagactgagcccaataaagagaaaaccacttcagatatttcaaatggaagagatttaatatagggaacttactgccttggtaatgttaatgcttaggagccaaacaatgaacaatgaggctaccaggagagaatcataatagctagataggggaagccattatcttccctgtggctagaggaaccaaaggagcaggcaatgctgcagtagcctggtggaagctggcaccccagaggctgtccacagggagctagaccctcataggatatgccactactactagagacactggtgaggtgagagctgggaattactctgtctgctctcttcctcccacccttcaatctccctccagtgtattccatgagttgaactcagccatacggctgtcagcagggaagtctgagaaatgtagctccttgtgatgtgaagcagagctagggaggaacaggaaatcaatctgagagcaaactggcaaaggatcaacacagtgagttactgatgtgctctcatactatatccaacgctctaacaggcatctgcagaatatgggtgttgtgtatttaagtaagatgttacatataaagcatggagtatagtgcttggcacattatttttatcagcagcagcatctttttgtaatgtgacagcattttcccccttcattccttcctctcttctcacccattttcctgctgaataagagtagggatcatgtggagtctcagggagataagaaataataaaataatacatccaagctatgccatgagaaattaagaaaaaaaatctgcttgttccatctacatgatagaatcagaaaagcttaaaggcttccactgggcacacagcaataacaagttctcagtgatgtagacttaggagtcatgctcatacctgcaggccgcttaaggaccatcttttggattgtgctgaagacatgggagaaaatgctttcatccacacataaaggccagctgtgtggcctggaaagtgactcaatggaaaggggcagttattcatggtatccttacctggatttcaggagtattgagcttgactggtatatcgatttttttccctcttgactaggaccatatgtgcatgcatttccagatgctgtggtcataactgagaagatatattattatcaagtcactaacagtcttcaatgatgaaaagaactgtttttctcagtagacttgttttccaagttaagttatcaaaagcttacaaaatagacacagttgtctctgccaggttatactgcaaagaaatcagagtgttggcaaatagctcctctgtggaagaaaacataagcaagcatatttgtattctggcctgtgctcctacagcatagggaatgcagcattctgtttagcagttccatcctggttcatcttgtttgggagttagcaagcaaagcctgtatacaacataacagtctccccctgaagacaaccatcacagcttcagctaactcattccaaccttaaaccaaaccatcttaatatagaactgtttaaatagcaaaaattttatggagaagcccattaagttatttataaatgagaagcccaaatgtatagctctgtaatacttcagagctgcgctatgatattttacttattcattacacatttattgagttaaaaaataaacacaaagcaacaatcctagagacttttaccatctggcctatgctaggagccaaaataattggtgcagaaaatgagtgccatgagttctggggaaagagagttagctgtgggttgaaggagtcagaaggtctccaaggtagagaggaatcaagttgggttttgatagtttggttgaagctggccaggtggaacaaatgaaaaagatgcttctgcctgagagaattggctttgtcaattactttgtggtgggaataaacgagttggttgagcaaggagattaaataagatatggttcaagaacctggaattcatagctagtctggctaagttagaaccttgccttcaccatttagtaatttataaataatattggctgcatcacttaatctcaatttcctcaagtccaaaataggaatagtactagtgcttgattcatggggttatttcaagtatctacaaaacaaatacagaggaacaacctaacatattgtaagtgctcagtcaataatcagctgctattatcacttccttcttccaacctatattgagtgcctgctatagagaaagcagaagagtaaattgagtcagaatatgaaatgctttgactgtaggtgaaagtacagacatgttttcctgctgaaatagaggagtcgctggagacactggatttaggcagggacatgacaagggctatttttaagaattaatctactagtatagtgcatgcaatgtgtcattcagcagcgtcttttataaacctttaatgaagccgtagagaaaattgagatgaggaatctcttggcaccatagaaggcatttaattactaagtaataaatttgggggcccttacaaataattgggattcccaccagtgactagttataccccaaggaacatacagactgctaacatggcagccaccagagccctgggtgtttctgggttcttaaaggtagagtgtgcaggggcaggtaacccacagttctccctgtactcaaaatgtggagcaacaaattgcaatggaagtagctaatatcacaggaaatgtggctatcgtctcttcagggtcttcaagtatggggtacaagcacaagggctagcattctcagggacattaactttgatccaaagagctagagcagcagttctcaaacttatgtttctgtgctgatttacgtaatggagtttctcatctagaaaacactcctgtgggtggactagagttatgagcaatgcccagccagctgcctttaactctacctccttctttctctcaataacatgtacctaaatgaaagtatattataattagagaaataattactctaatttatttattaataaagtaaattattcaccaattttggtatgttatcattagtaataaattatttgggaatccaaagaaaactggtatgaacataccaggttatcactgacattttaactaagaattttgagtccaaagactacttgagtcatgctctatcattcagcaacgtcttttataaacttttaatgaaggagtagagatgattaagatgaggaatctcttggcaccataaaaagcatttaattactaagtaataaatctgggtgcccttacaagtaattgagacccccaccagtgactgaatataccccaaggaatatgcaggctgctaacatggccagccacccaaacgcccagttatttatctggcaagtacaaggcatgaaacaaacttctggactcttttctctttgcagactccagtatgaatggtgaatgtaatttaatgtgtcatggaaatgcagagctgtagaactgattattatgcccagtataaatggaagagctctaatctacgagtggaggtgaagcatccccagtggccaggaggacaaccttgcccagtgacctttcctagaagaaggtattgaagtgctaagatgaggatttccacaaatttctgctcaggcaacaccacccatcatcaactgagttaatgcccatccctaaatgtgtgtaacatgggcgaagtgaattttttctttctctgtcatgctcacttcccacttacctgctagagtaagagtatactagcatattatttagacatctagtttttaataatattcattttcatacaacatgaccacaaagaagaaactgttatatcttataatggaagaaaatctgactgtggagaagttactgagaaatggtacatctgcattatgctttatgggtgatttaaaggattttcaaatattattttgactacaggtaaaataactgtataatttatcatacaaatttgaaagcatttgagtcagacaggatattaatgataattaggctgaaatgacaggcataaatgaagagccttctggtaaattaaaatgtagtaccatcctaaatattatgggctgaactgtgtttccctcaaatttatatgttaaagttctaagtctctgatatggtttggctgtgtccccacccaaatctcaccttgaattgtaataatccccacatgtcgtaggaggaacctggtgggaggtaattgaatcatgggggatagattttcccatgctgttctattgatagtaactctcatgagatcagatggttttataaagagcagtttccctacacatgctccctcttgcctgctgccatataagacatgcctttggttttccttcaccttccaccatgattgtgaggcctccctagacatgcagaaccatgagtccattacacttatttttctttataaattacccagtcttgaatatgtctttaaatagcagtgtgagaacatactaatacagtttccatagtctccatacctcagaatatgactatattttggaatagggcatttaaagagatagttaaggtgaaatgagatcatgagggttggccctaatccaatatggttggtgtccttataagaaaaggaaattaggacacagacatgcacatgcacagaggtaagaccatttgaagacaatatgagattatgaccatctacaagccaaggacaaaggtcccagaagaactctaacctgcagacacctaaattttggacttccagcctccagaacatggagaaaattaatttcttttgtttaactcagccagtctgtggtattttttgatggcagctatagcaaactagcatactaatgatagtgattttcattttaaccatcagccttgaaactaatcacatcataagttgaggctctgccataacatcagttatgtcctgaggccatttggttgaataattgataaactgcttgaagcatgaccctacgaatagccctaaccatccatctcaaggcagagatattttatcttgttttattgcctaacagcactaaaaaaagaaaaaaatcttggttccattccaagatggccaaatagaaacagctccggtctgcagctcccagtgtgatcgatgcagaagatgggtgacttctgcatttccaactaaggtacctggttcatatcattgggactggttggacagtgggtgtagcccacggagggcaagccaaagcagggtgggacgtcgcctcacccaggaagtgcaaggggtcaggagatttccctttcctagccaaaggaagccatgatagactgtacctggaaaaatgggacactctcacccaaatactgcaattttcccacagtcttagcaactggcagaccaggagattctctcctgtgcctggctcagtgggtcccatgaccacgtagccttgctcactgctagcgcagcagtctgggattgccttgcaaggctgcagcctggcagggggagggatgttcaccattgctgaggcttgagcaggtaaacaaagcagccaggaagcctgaactgggcggagcccaccacagctcagcaaggcctgctgcctctatagattccacctctgtggacagggcatagctgaacaaaaggcagcagaaacttctacagacttaaacatccccgtctgacagctctgaagagagcagtggttctcccagcacagcatttgagctctgagaacagactgcctccttaagtgggtccctgatcccagtgtacccaaactgggagacacctcccagtaagggctgacagacacttcatacaggtgggtgcccctctgggatgaagcttccagaggaaggatcagacagcaacatttgctgttctgcaatattagctgttctgtagcctcctctggtgatacccaggcaaacagggtctgaagtggacctccagcaaactccaacagacctgcagctgagggatctgactgttagaaggaaaactaacaaacagaaaggaatagcatcaacatcaacaaaaaggacatccaaccaaaaccccatctgtaggtcaccaacatcaagaccaaaggtagataaaaccacaaagatggggagaaaccagagcagaaaagctgaaaactctaaaaaccagagcacctcttctcctccaaaggatcgcagctcctcacctgtaatggaacaatgctggatggaggatgactttgacgaattgacagaagtaggcttcagaaggtcagtaataacaaacttctctgagctaaaggagcatgttctaacccattgcaaggaaggtaaaaaccttgaaaaaaggttagatgaatggctaactagactaaacagtgtagagaagaccttaaatgatgtgatggagctgaacaccatggcccaagaacttcatgatgcatacacaagcttcaatagctgatttgatcaagtggaagaaaggatatcagtgattgaatatcaaattaatgaaataaagcaagaagacaagattagagaaaaataagtaaaaagaaatgaacaaagcctccaagaaatatgggattatgtgaaaagaccaaatctacatttgattggtgtacctgaaagtgacaaggagaatggaaacaagtgtgaaaacactcttcaggatattatccaggagaacttcctcaacctagcaaggtaggacaacattcaaattcaggaaatacagagaacaccacaaagatacgccttgagaagagcaaccccaagacacacaattatcagattcaccaaggttgaaatgaaggaaaaagtgttaagggcagccagaaagaaaggtcgggttacccacaaagggaagcccattagactaacagtggatctcttggcagaaaccctacaacccagaagatagtgggggccaatattcaatattcttaaagaaaacaattttcaacccagaatttcatatccatccaaactaagcttcataagtgtgggagaaacaaaattctttacagacaagcaaatgctgagagattttgtcaccaccaggcctgccctacaagacctcctgaaggaagcaataaacagggaaaggaacaactggtaccagccactgcaaaaacatgccaaattgtaaagaccatcgatgctatgaagaaactgcatcaattaaggggcaaaataaccagataacatcataatgacaggatcaaattcacacataacaatattaaccttaaatgtaaatgggctaaatgccccaattaaaagacatagactggtaaattggataaagagtcaaaatccatcagtgtgctgtattcaggagacccatctcacctgcagagacacacataggcttaaaataaagggatggaggaagacctaccaagcaaatagaaagcaaaaaaagcatgggttgtaatcctagtctctgataaaataggctttaaaccaacaaagatcgaaagagacaaagaaggccattaaataatggtaaagagatcaattcaacaagaagtgctaactatcctaaagatatatgcacccaatacaggagcaccaagattcttaaagcaagtccttagagacctgcaaagagacttagattcccccacagtaataatgggagactttaacaccccactgtcaacattagacagatcaacaagacagaagattaacaaggatatccaggacttgaactcagctctgcaccaagtggacctaatagacatctacagaactctccacctgaaatcaacagaatatacattcttctcagcaccacatcacacttattccaaaattgaccacatagttgcaagtaaagcactcctcagcaaatgtaaaagaacagaaatcataacaaactgtctctcagattacagtgcaatcaaatgagaactcaggattaagaaactcactcaaaatcactcaactacatggaaactgaacaacctgctcctgaatgacgactactgggtaaataacaaaatgaaggcagaaataaatatgttctttgaaaccaatgagaacaaagacacaatgtaccagattctctggaacacatttaaagcagtgtgtagagggaaatttatagcactaaatgcccacaagagaaagcaggaaaggtctaaaattgacaacctaacatcacaattaaaataactagagaagcaagagcaaacaaattcaaaagctagcagaaggcaagaaataactaagatgagagcagaactgaaggaaatagagacacaaaaaacccttcaaaacatcagtgaatccaggagctagttttttgaaaagaccaaacaaaattgataaaacgctagcaagactaataagaagaaaagagagaagaatcaaatagacgcaataaaaaatgataaaggggatatcaccaccgatcccacagaaatacaaaataccatcagagaatactataaacacctctatgcaaataaactagaaaatctagaagaaatggataaattcctggacacaaacaccctcccaagactaaaccaggaagaagttgaatctctgaatagatcaataacaggctctgaaattgaggcaacaattaatagcctaccaaccaagaaaaagtctaggaccagatggattcacagccgaaatctaccagggtacaaagaggagctggtaccattctttctgaaactattccaatcaagagtaaaagaagaaatcttccctaactcattttaggaggccagcatcatcctgatcccaaaacatggcagagacacaacaaaaaaagagagttttagaccaatatccctcatgaacatcgatgcaaaaatcctcaataaaatactggcaaaccgaatccagcagcacatcaaaaagcttatccaccatgatcaagtgggcttcatcgctgggatgcatgactggttcaacatacgcaaatcaataaacgtaatccatcacataaacagaaccaacgacaaaaaccacgattatttcaatagatgcagaaaaggcctttgacaaaaatcaacagccttcgacaaaattcaacagcccttcatgctaaaaactctcaaaaaagtaaatactgatggaacatatctcaaaatattaagagctatttatgacaaacccacagcaaatatcatactgaatgggcaaaaactggaagcatttcctttgaaaaccagcataagacaaggatgccctctctcaccattcctattcaacacagtattggaagttgtggccagggcaatcaggcaagagaaagaaagggtattcaattaggaaaagaggaagtcaaattgtccctgtttgcagatgcacgattgcatatttagaaaaccccatcgtctcagcccaaaatctccttaagctgataagcaacttcagtaaaatctcaagatacaaaatcagtgcgcaaaaatcacaggcattcttatacatcaataacagacaaacacagagccaaatcatgagtgaactcccattcacaattgcttcaaagagaataaaatacctgggaatccagcttgcaagggatgtgaaggacctcttcaagaagaactacaaatcactgctcaatgaaataaaagaggacacaaacaaatggaggaacattccatatttgtggataggaagaatcaatatcgtgaaaatggccatactgcccaaggtcatttatagattcaatgccatccccatcaagctaccaatgactttcttcacagaattggaaaaaactactttaaagttcacagggaaccaaaaaagagcccgcatagccaagataatcgtaagccaaaagaacaaagctggaggcatcacgctacctgacttcaaactatactacaaggctatagtaacaaaaacagcatggtactggtaccaaaacagatatatagaccaatggaacagaacagagcccacagaaataacaccacacatctacaatctatgatctttgacaaatcttacaaaaagtataaatgggtaaaggattctctatttaataaatggtgctgggaaaactggctagccacatgtagaaagctgaaactggatcccttccttacaacttatagaaaaattaattcaagatggattgaagacttaaattttggacctaaaaccataaaaaccctagaagaaaacttaggcaataccattcaggacataggcttgggcaaagacttcatgactaaaacaccaaaagcaatggcaacaaaagccaaaattgacaaatgggatctaattaaactaaagagcttctgcacagaaaaagaaactaccatcagagtgaagaggcaacctatggaatgggagaaaatttttgcaatctacccatctgacaaatggctaatatccagaatttacaaagagaacttaaacaaatttacaagaaaaagtcaaacaaccccatcaaaaagtgggcaaaggatatgaacagacacttctcaaaagaagacatttatacagccaacagacacatgaaaaaatgctcatcatcactggtcatcagacaaatgcaaatcaaaaccaaaatgagataccatctcataccaattagaatggtgatcattgaaaggtcaggaaacaacagatgctggagaggatgtggagaaataggaacacttttacattgttggtgggagtttaaattagttcaaccattgtgaaagacagtgtggtgattcctcaaggataaagaactagaaataccatttgacccagccatcctattactgggtatatacccaaaggattataaattatgctactatgaagacacatgcacatgtatgtttattgtggcactattcacaatagcaaaaacttggaactaacccaaatgtccatcaatgatagactggattaataaaatgtggcacatatacaccatggaatactatgcagccataaaaaaggatgagttcacatcctttgtagggacgtggatgaagctggaaaccatctttctcagcaaattatcacaaggacagaaaatcaaacaccgcctgttctcactcataggtgggaattaaacaatgacaacacttggacacagggaagagaacatcacacagcggggcctgtcaggtggtggggggctggtggagggatagcattaggagaaatacctaatgtaaatgacgagttgatgtgtgcagcaaaccactgtggcacatgcatacatatgtaacaaacctgcacattgtgtacatgtaccctagaacttaaagtataataataataaaaaaaatcctaaacaaaaataaaaagtgattcgggtcctgtctctgacacttgttaagcacatgcttagttgtgcataatcaaatagatcctccgaaccttatttgattcatgattaccacagagcaatatttggtctacttgactcagagagttattacatagctcaaacaagaccaaaacagtgatatgcaaactgcaaagcagttgagattgttaattttatgcatcagcttgactgagccatagggtgaccagattgaacattatttctggatgtgtctgtgagagtgtttctgaatgagatgagatttgaacagtgtgaaaggaaaataaatcttggggcccccaaatcactaagctaaagggaaaagtcaagctgggaactgcttagggcaagcatacctctctttctattcaaagtcatccctctgctcactgagataaatgcatatctgattgcctcctttggaaaggctcatcagaaactcaaacaaatgcaataatttgtctcttatctacctatgacctggaagacccttccccttcaagttgtcctacctttgcttcgagttatcctgcctttccagaccaaaccagtgttcatcttatatatgttgattaatgtctcatgtctccccacaatgtataaaaccaagctgtgcttcgaccaccttgggcacatgtcattaggacctcctgaggctgtgtcatggctgtgtgtccttaatttcggcaaaataaacttcctaagacctgtcttagattttggggtttacaataggtatacccagtaaagtaaatggctcttcccaatttgagtggggttcatccaattcactgaaggcctgagtggaacaaaaggtaaagaaatacatctccttttattttctacttcactgcttgagctgggaaatttcttctcatcttctcctgccctctgctcccctggttctctggcctgaagacttagattaaattacaccattggcatcctagactctctagcttgcagatagcagattgtggaacttcttagcctacataatcatgtgagccagtttctcattttatgtatgattatataaatgatgatgtatgatatgtatatattatattctctagagaatcctaatacagtggcccatgctatcaggcatcataaaccgaatgagagtaagaaaggccataagtatttgtaaattttacaggataattatcacactgtaaacactgtaccctggttctctttttggatattaaaaataaatcaggaaaatatataaaataacactgaaaatgttcaagactgtttaaggtagttccattctcttaaactcatctttgaaacaagactctaataaatgtttcctatggtgagtttcttgtcttgacttttaactatgtcatcagctcatgatgcagttgtaaccacacagtgaaatagtgttcttggcaatcaaattggtcctgaggtcaaacatttcttggagagtattatgaagaaataagatgaatgaatcaattctattgtgcatttattgcaattcatataagatgaagaaatataatgtagaaaattggtcactgaattaccagccactaacatggtattataaaggaaatgagatttaaatctgagaaggggattgtgtgcaagaacaagaatttgcaaatagttgacattagatccatctactcattcattcattcataaattcattcaaaaataggtactgagctctactgtgcgtgtaactcctgtctcaaaatttaaactgttgtttcagaatttagaattaagagatatctaatctcttactgattgatagacatgaccttgtacttatttgattctggtagaaaatgctaataaaaataatcaagaattattaggaatcattgactatccttatttgaacaacaaaaataattttgataaattatccattatattctatttgtgaatgtattagaaaattaaaatcatttaataataaattttgtttgtatcttacctaattccaaaccaacagcgacaaaaaacaagaatataaagaggcttgcttatctattgaagtaaaagtaattcagaactcttaaaaagaatgttgattttggtctttagtttcttgaagtcttctttttgaagaagtgacatgctgtggggaaaacctcttttatatttaattgtcttttttgtccaggaagtattcctagccagtgtgtcattatcttttaaaagtatgagaatacaatgaaaattaatgggtttctttaaactaacaatgaaccttcttcatgtaccttatcatattcttcaaacagcctctaatggaaaaagaagattgtgtttctaaaaattccccacagtgcaccaccacttcttttatatgttaaaaaaattcaaattaatgttattcataaaaacgtaggtgaaacagcctaaaaatagacccaactttttacattgaaattatcagtccttgcctaaacggtcatgtttagacaacaggacaattattttcaaattctctcaagtaagaggccaggtgtcaatattccccagaattatttgcaagtttcaagtccacaaatccatttaattttgctttaaatcagcatccgctgctacaccctggcaacccagaggtgtaaactggctcaaatatgtgtttttcttgttctgaacatttatcatcattatcgtcatcatcatcatcatcatcatttaatttaaatgctttaagcagtcctctattttccagtttcttattctgaaattactcattactgacttattcttagataatctagacatgtagaaggtactcaagcttagggttaaagacaagcactggagtcagttgtcttggttggtgaccttaccttataacttgttagctgattgactcattttttgattcttcagattctccatctataaaatgatgataataacagtccctatttcatcataatgaaatcataatgattacatgcaatactacctgcaattacctcaggaaatggcacttagaaaatcctcaagaaatgttagtcattgttcttatctgccccctgacaatatttgtatcagcaatctctgctacagtggactttgctaaaagaaagacattatctagcacacagttaatactaaaaaaaaaattactcttattagtgtctggcttctaaaaggatttgttgacttgcaaatcctgctaaagtttactttgtttagataactaggtacaattaggaacaagtggttctctagctgtgcctagagaactagttacaatttttaagctgtctggaatcttaaatcctaaagtctctcagattgttttttttttcattctcctttttttttcccatagcaactaaatcaattccaagaatcacaaagagaaaaaagaatgacaaaccgagggttgtaatcctagaaaatttataaagtaacataacagcatacagcatacatattctacgttgcacttatcataaccctaaagagttcatatttgtaactaaaattagcaggaatttatactgtccttcaggagtaaaggcagctgtgagctccaaattcttccttctcttttcaaaactcctctataacccgtcacaccgtcagagaataaactcacttagcaaaaccccaaagaagtgcctgcctaaccacttgcaaattagatacctgctggggtaagcaagacagtacccatgcaagaatgaagaggagaggggagaaggctgggatatgctctgataaaatgcacaattcgaggaaatagtctaactgcacactcagctcctgttgtctagggaagacaaagaaatatgtaaaattcaagctgacatactatgaacagtttcataatgaagctatatcacttattagaaaattatgcagatgaaccctgtattatggcagagggagccgcagaatagccaagaagctggctccacatggagacagacctcatggtcacgaaagcagtgaaccttgtctcctgacccagaacttgccattctgccaactgctgttcataaaattgaaataataaggaagaaccactaaaaatcattaattttgcaaaactagtggtattagaaaaggtatgagctttggagtctaagacatgtgatttgaattatgtttcttccagttctagctaggtaatcttgggtagaatacattatatctgaacctcagttatagctggaaaacaagattatgaataccttcctcttggggttgagataaagattgaattaaaaaaactccccttcccaaagtaaaacacgttcagtctttgtcctcccctgcacaaatgaactcattgtctcaggagtacagccaggtagacagtcacatccttctgtggaagtgatacagacatcctcactgcatgtgaaatggaagaaatattcttgtatattgtttaactgaaggatgaaattaaagttagaaatgcagactaggtagcccttatcccgccgtttatatgcatccttcctgtctacagaacacaactcagggagcaaataggagaactacaatggagtgataagaaaaaattgtcattcttgcatctgttatttagccatatctccagctcacccattttattatagttaataacgatggtaatcattcactgagataaagtactaagtactttatacatggaatctcactgaattctcatagttgcttttggagatgagttctttctttatctcctttttgcaaatgagaaaacagagcctcagagaggtttagaaacttgtttaagatcatacagtagctactgaagttgaagtcatgatttgaatgcttgtctgattctacattctctcttcttgtccttgtgtttccatccctctggcctttgactgccacagccctgtggctctccttcattgaactacctagttaggtatacctctcaagatctagctgtgatcccttctcttggacatcacttcaggcttgtttctggctccaaatctctatgaatatagataagagatacactcaaaacctttacctagcctcacaggggtttatccttgtagcatagacatatcttcatgacaaagtgaaccaggagtgtttgaaggcctgctttgtaaccaactgcatcaacattagggaaatcaccaggtgctttcatcattttcttctgtaaaataaaaatttataatgtgcttacaaactacatagctctttgggaagtaggcaaattgaatttttcaaattctcagtggcaagctgggcagtaaaacataattactgatttttaatatgtactttgtggcccttgtaattcaaagatgatgattttgactatcatcactatcagtgtgaaacaacaggagctcaaagagaatccaaagcttgatatcattcctgccctcattttagtgttgaaataaaagttcttaaggatttgaagaacatacttaggagttctctccatagcattttcatagcactcaaggaagtataaggattagctacagtgatcccaaatgctaataacatgaattttccaaatcagaaagtaaatactcagggcatagaaagagctctcgagtaccactgtgagccccaagatatctgataaagcatgagtgtttgggttttggtggctggaaggatggaatggagctaagcttataggttaaaagttacttatctttattctaagaaaatgtgagcctcataagttatctctgccttgatgatccctcttttacaattctcattgttaacacttaatttctgtaacattagcttacaaggattgtttctcaagtggaatttctgcctccaaacataataggcttacaacaaccatattattttcttttttgaaaattcctaaattcatttacgcatttgctcttacacctatcaatgcatccaaaccatatatttattgagcagatatttattgaaagcctgttcagtgctaggtacagggagtttaaaactgaatggcatggtttctgccaagaggaatatattagaaatttatagaaggcagaatactattatataacatcatcagagctataacagtagtgcagataaattgttttgagaaaacaaatttgggcagaagaaattgtttcccatgcataggaaacaataaacatgtgttggatgaaaaaaagaacatgtaatccaccggttaaagatggaaggacctcagttaggatagtatctcatgataatttttttttctttttacaatatagcacttattttaatgatacgaattgatgaatgaataaataaatgacaagtcaatgcacctatattatggaacagtagatatcagaaaaagctaaaggaaatttcaagagccatataatcaaatagattataaggacacacaaaccaaattaactgtagtgaaagataacatgagacaagaacaatgagaaataaataacaaatatgggtgatttcatagtatgaagagtactatttgttagaggcaactatcttagaagaaaaagtacatgagttggacttcgatggttggggtcctttgcataaagtcagaaaaggacattgcaagtgaatataaagataggaaagcaagggaaagaagatgaggaattatggtattcgttcaatcttgcagaaatgcaggatggaatggaaaactggaaaagccaagtttatatcaaaggagaaaggagttttctcctaagggtttgaaatctatggtgggtaaaagggagatattaaagtatttggggataaagactaacatgattatctctaaaatccaaatatgcaattatgtgttaaatactaacttcattttccagattatattgaaatcatcaaaggccagtgcggtggttcatgcctgtaatcccagcactttgggaggccgaggtgggcggatcacttgaggtcaagagttcaagaccagcctggtcaatatgatggaaccccatctttactaaaaatacaaagattagctgggcatggtggtgtgcacctgtaatcccagctactctggaggctgagacatgagaatcccttgaacctgaagggtgcagtgagccaagatcacaccactgcactccagcctggataacagagtgagactgtctcaaaaaataaataaataaataaataaataaataaataaataaataaataaaaaataaagaaagaaaagaaaaagaaaaaaaaatacttcaaatctttcctgtacctaaaacagttgtatttttccatcatatttacatgtgatttatttgaagccatctgcagtttgtttcttattctattttgttttctcacccaatagctatttattctgttcccgttgttgttattaaccttggcagcaaaaatttatctacaacaccttcagaatagaaaatatacagattagcaataatttgaagcctgagatcaggatgatatgtttttgtccattaaggaaatgttcatattccagttttaagcagctcatatctgtctaccaaactcaagaatacttacattctgaaatatctgaaattacaagtgttaattttttatgcagattgttctgctattctgttttctcatgcttaccactcaggctgagctcaaactatgaataagtgattaactggtgtgaactatgtggccatggtgatgttcagaatggtatgcttgatgatcctatcatagatagtgttttgatataagcattagatttaaggcttaggaattgcacttttcacacatatgtttaaacgtagtgacaatttctcctaatgttaaaatgcattctctgataaataaggcttgaacgctaccggtgaatatgtggagctcagtcagctatctcagctgctgcaaagatatagctattacatggttggtttgacagacaaggagctatcctctttaaaaaaataaaaaaaacatactccagcctacaacccgcagaggatgctgcatgcaacgcagtgattatgaatcctaccaaattttcagccatgccagcaattgcctcttcctcatatggaaatctttgcagccctgtcttcagaagaaaaacaaaggcagaggaaaaacaaaaaggaaattcctgtggtaagagagctcaagattcttgctctggcacttaaaagaacaaagccagtaattgccagagtagaacagacagagcactaacgatgggactgcaaaaagtacttgggctagctagctcaagaaggtgaaagacaggttacacatgctagcccttgagctaggagaaacagctattatcctaaagctgaggagaacccaatttagctgtaagactagggatgagggaaaaaaacacaacaacaataaatcctatctctatagtacctggtctttacccagttagaaagcagtagaatgaggaacagagagaaatagagaaacagagacagggagagagaaacaaagagagagagaggggagggagggagagaggtagttccagtttattatgtcaattatgcactaaaaatggggttgtcatggtctaaatgtatttcctaaaacttatatgttgaagtttaatcaccaatgtgttagtattaagagctgaggcatttaggaggtgattaactcatgaggacagagcctcatgagatcagggtctttaaaaaggcttgagggagtgattggctctcttctgccctcctgccatgtgaggacacagcgtttcccttctgatgcagcactcaaggtgccattttaaaagtggagagaacagcccttatcagacactgaatctgctggcatcttattcttggactcccagcatctagaactgtgagaacatagcttcctattgtttacaaattacccagtctcaggttttttttgttgtagcagcatgaatagactaagacaaaatcttactttaccttttgaccaaattaacatgcatggactgggaaagtagatacataacctgttttcttgtatctgatttgtcttacttctacctttttgcacccacttgattcttttctatcttgttgtatgctgcttcctttatttgcctatcttagtgttattttcttcattagggtctgagccaagcactgtcctgtatgctggagactctacctaactggacatacttattgcctttcaagagcttgaaaggaagatcaaaaccaaggctgggtcaggatatttattcttagcaagtcatacattttatattgagaagaattttataatttgaagtatgttcatcattccagtggaattttgataagaatttcacccaacccatgcaactgtgtcaaacagaaaaatcctgatggaaaatcatggctccatgggggagtttgctctggtggaaatacatctgtgtaggagttcctgttaaaagaagacacatcactacattttacctgtcagggattttttttaagtctacatatgcaaaggcaaagttgtcactagcgtgtaaacacagaatctctgggaaggatttgcaatatgacatctttccatgtctgctgtatttgattcgagatagcaaaaatgcaagtggttccccagagactacctatacaggcaggtttggagctagtgtttgtatcttgcagggattgtgaaataaagcgtacccatgtttaactctcaacacctcttgccaggctgagacaaaatggtgaaacaaggtggtcagcctggagttgtgaaaagagggtgggatttggattcagcaagatgtgagtttgaattccagctctatcacttttagttggggagtctctacaatacactttgattagggtagtgatacctactgagttgcagtgattaatggaaacactgcataaaataatcttattagaatgactagaatttaagaagctgttacacacacacacacacacacaataaatatgacgttagtttgacaatactgactacactacacataaaaataaagttcaaatctgtggtttaaggttattcttatgacattaagaccatttgtgatttagaaaatcgtatctaatacacgtgcttatgtaagggagacatacactccccccaaaatagctaaaatgtatggaacacataatatgtgccaggtcctgttcaaaaaaatttacatgcatgattctcaaccatttatactaaatccaattattagtccaatattatcttcactctgcagctttggtaactaaggcccagtaaggttgggtaatttgcccaaggttacacaaatactaagtgatgtagccaaatagatgtaggcagtctggttctagagcctgtgaagttacttatcgtaccatactacctagattttccctaaaaagtcaacaattattcttagagcagaggggagcctcatatagtatcaatttaattaagaaatatcaccctttccttgaggagttttaagttgaataaaaaataatggatataattctagttactgtgtggttaattgctaacacattgcagcacaacctatgtatgttctggattatacaggtgaaagaataacagggcaaaatttggaatggccaagaacagtcttcattcatctgtccttctatccatccataaatccattcatccactaatccatccatccattcatttgtcaatccatccatccatccatctacctatcctttctgattgcagtaaagggatgcagagcaaaatcttacagttaggtagacctaaattctagctcctgttttatcacttactagctgaatggtcttgagaaattaaggtaacctgattgagtctcctaaaatggaaaaataattaaaatatacttaatggtagtgttatgagaattacgtttatagacttctaggcacagtatctggtacaaaattaacactaaataaatgatggttatcaatattaacattaaagcttttatgtcaggtaccaaattacagttatgttctgaagatataaagattaataagatatatttcttgccctctaaaagattccagaagtttagtagggactttacacaagtgtgataaatgtggaatggttagttctaccatcgtttagggataagggaatcaagaatactaatagtagttggctgggcatggtggctcactcctgtaatcccagcattctggggggccaaagtgggagggtctcaggaacccaggaggttgagactgcagtgagccatgattgtacctttacactccagcctgggtgccagagtgagaccctgtctctaaaaatttttttaaaagaagaatgtaatttgttgagattttctgatgttcagatgctgagctaagtagttgtagcacttacttactatctcatttaattccaatgagaactattattacctctattttacaaaagaggaaagtgaggcttaaagaaatgcagtttgttgtttggagtcatgcatttaagaaagggaagggccgagaccttaacccaaataattttttttttttttttttttttagacggagtcttgctcagtcacccaggctggagttcagtggcaccatctctgctcactgcaagctctgtctctgcctcccgggttcacaccattctcctgcctcagcctcccgagtagctgggactacaggcacctgccaccatgcctggctaattttttgtatttttattagagacggggtttcaccgtgttagccaggatggtctcgacctcctgacctcgtgatcctcccacctcggcctcccgaagtgctgggattacaggcttgagccactgcacccggccaacccaagttattcttaatgtggaaaaactaagaagactgcctctaagctacattttaaaagattaccacccatttttaagtagatagatattgaggtgtattaaagacacaggaagcagtaaggaaagtgacaaaaataaatcaaactatgtggcccagttagaaaatatgaggtgattcagtgttcattcaaaaattgtttattgagggtccattacatgtcagggatctttcctaggtactgaaggtgcatggctgtaaaacatagactaaaattcctgccaacgtggaccttattatccattctctgggagggagacacccaaagtaaaattaaaaacacatgattaagaagttcattataaagtaatatatacaacatataataaagtataaaaacctatgttctaagtgctattgagaaaaaaaaagaagcagagaagacatcaaagtaggttgaaagtagggagattttctggttttaaatggatagtcagggaaggcttagccaagaagatgatatgcggacatataagctctgaagcgctgagagtgagccatttgggatatctagcagaaaagcttgccaggtacaggaggtagcatttgcaaagacccaggaaggaaaaatgactggcatgttggaggaacagacaggaggtcatggattgaaatatatatatatatatatatatatatatatatatatatatatatatatatacacacacacacacacacacacacacacacacgtgtgtgtgtgtgtgtgtgtattagcagaacatagaaaaagaaactagcaatgcaagagaggaaaaggagaattctagagccaaatctttgagcagtggaaggggtagggatctagctcacaaatatggttgatgtatgaaacttgtgcatgtctggtgggggtaggggtgaaggtgggagtgtttgaggtcaaatagggcaattcagccagagattaaattagaggtgtataggaaccaaatcttgaaggctcttccattacaggcatagatgtttggactttgtgctagtaaaaatgaggatctttaagggttttaggtacaggaatgaaatattccaataagtttcaccaggaaagtgaaacttctgctgagctttgaggcatttatgggatttgaatacatgagaggtaaaagaaagaacaatgtaggcaagaaggtcaacagtaataatgacccagaattggaatagttttggcagatggggaaccagttgaagatgtgtgctggcagacacctctgggggaaagaaaggaaaatatgagttatatctaaaaggctctggaatcaatctgcttaccaggtgcacactctatcacatactatctctgtgagcttgagcatgatccctaatttcttgctatctaatcacttgatataataaagataataatagtaatttcctcataaagaaaatgaaattaaatcatatggataaaatattacctgtatgcctgacacacattgttctcactaaatgttagttgttattctatatagcatcttgggaacctggagaggatgtaagagattggttccagatgtatggaatgtactagaaagaaacatgattgaaagcactatgatttcaggaggctgattatattatgtaaatctaaatattgatctctaatattcaaattcatcattttaaaggtcaaggcttataacagaattcatctagactaaccctggagataatataagaatcaaaatagctcttaaagttcaacagttaagcagttgagctgtggaaataggatatttatgagtagcttacacacacacacacacaaacacatatatattgtaaataaacacaatggggatctccatactgctaccaaattttcatattttataagccacaatgtgctagaaacaaaatttggtgcttcagaagaatgtttgattaatgatcatttctttgtaattagttatttgaatggacagcaacatcaacatatggaagaattcagaaaaaaagaacacagcatcgtacttcaggagtctttacattttctagaaggccaaattataaatagagtcttatctcacctatcatgagagcagattgctacttatgtatccatttataatttatctgaaaattccattttttaaagtttctgtatattcaatgtatcaaactggatagagagttcttttttcaagttttccagtttggtgaatagatagatagatagatagatagatagatagatagatagttagatagacagacagacagatacagatatagatatagatgtgtatatatatgtgtgtatgtgtgtgtatacaacatattgcttttccttgttaaatagcttgttaaattcagttctgtttcatgcgttaaagattacagcaggtaggtttctaaaaagtcatcatagattctacactgtttgggaatacatagctaatatctgcaactaaggtgaacgtgagaaaaatcacttatttggttttgcaactacagatctaactctcaagcattaagatatttcgtcaaattgatgttgaaaggtatctagcaaattcatgaaatctcatcctttaatccaaaattactacaaggaatatgaactaaaaaagccaaaagaggctatcacataataattagatactagatcaggcagtttttgtgttcagttctcaaaatactgaatatctcaaaatagtgaggagtgaatacaagagtgttaatcaagttcacaagtaaaattttattcccaatttgacaggtaggtgggtaaatatgaaacttagctgtgcctcatatggttgtgttgataggatttaatttaagtgactggatgcctactagattattgggcagaaaatataatttaaacataatttggccattaattagtcttaatggattggataaaatggctcagtgaacagattaaaaaaaattttctaatggtaaataatcctgtaagaatatctttagcctgagcaacacagcaagaccttgtctctacaaaaaatgtaaaaaattatctggctgtggtggtgtgcacttgtagtcctagctacttgggaggctgaggcaggagaatcacttgagcctgggagttgagggttgcagtgagttatcatcatgccacttcatgccagcctgggtaatacataatctgtctcaacaaaagaatatccttaaaatacaaagataaaatataaaaaaaattttagtgagattttagaaagtagagagatagagtagacaatttaatacaactttcaactaaaaaggtctgagagacttacagaagtttgtgttgtagaaatctagtgtttggttttctcagcagatattttcttttcttttggtaatagcagttggggtttcctttgggaaccgattccatttcatattgtcatgttatttgatatcaataagaagagccaaaaaatttaaggccaaactacaaaggttcatggccaggttctggcccagtgtaatgatcaacaagtcatataatcttcataaaggttgggtttctcattttcattttatcttgtttatttatttatttatttattttgtgatggagtttcactcttgttgctcatgctggagtgcaatggcatgatttctgttcactgcaacctctgcctcccaggttcaagcaattctcatgcctcagcctcccgagtaactgggattacaggtgctcctccatacccagcaaattttttgtatttttagtagagatggggtttcaccatattggccaggctggtctcaaactcctggcctcaagtgattcacccacctcggcctcccaaggtattgggattacaggtgtgagccaccacacccagcctagggtttctcatttttagaatagaagcaacattagcactatgttagtaaaatgccaccacaaatactttgcagaattactgtaacaattgcaatagagaaaggattgctacatcgatattaagaacacctagggggtgcttgctagtgtaaaccaacatgactaaccacaataggtgagtgtattagttcattttcaccctgctgataaagacatacccaagactggctaatttacaaggaaaaagaggtgtaaaggactcacagttccatgtggctggggaggcctcacaaacatggcggaaggtgaaaggcaaaaggcacaacttacatggcagcaggcaagagagagaatgagagccaagaaaaaggggtttccccttataaaaccatcagatctagtgagacatattcactaccatgagaacagtatgcgggaaaccatacccatgattcagttatcttccaccaggtccctcccacaatacatgggaattatgggagctacaattcaagagatttgggtggggacatagctaaatcatatcagtgagcttcattacaagttttaaaaaatgaaggcaacaacaggtgaactgtatggtatgggcatgataacttaatagagtgttttaaaatatgatggcagtttattttcatcaatggttggtcttttcattatcaacatgagaataacaaatgtatcttatataaaatgaaggatcaggttgatgtctacttgacattccccatgaactacactggtattagggagacattagatactcccagatatactggctttggcttcctgggaatggagtgtagcttggtgacagctgggcagagagcctcaggcatgctccccattcctgtgcagagggcacagccatggaaagcatttcttggacttatttataccatcagtaccctaatgacagaagaaatacagcttatttcatattcatttttaaaagtaaccttaaacatcaggaacacaaaagaagtggtagagaattcggaggtaataggggaacaaaaagcatttagtgtgataatttagagggtgtgtgcaaacttcatgcagatttaaatttcccaacagcttgcaaataggttactcaagtattcaaaagcagaaatttctagaggtgcattagtcgtaaaggccatggaatgtagccttttatgtttattgttttcatttacattctgtccaaccctgagtcttgtagtctaaaagggtgtgacatgtgtgttcaattgcatccaagaatgtcttctgaaactgagtccctccactgtagaataaaaacagcctgggttcaaatagcagactcacttcccagtaaagctggcccattgacttgggccatttacttgtattttctgagcctcagtttcttcatctgtaaactgaggggctaataatgtacttacactatagtggtaaagataacatgggaaaatatatgtcaaatgcataggtccaggggtatagtgcatttgattaagagcacaacaaataattacaattatcattgttaccctttttgtgaatttttttctttttttttttttgagacagagtctcgctctgtcacccaggctggagtgcagtggtgcgatctctgctcactgcaagctccgcctcccaggttcaccctgttgtcttgcctcagcctcccgagtagctgggactacaggcgcctgccaccacgcccagctaattttttttgtatttttagtagaggcggggtttcaccgtgttaccaggatggtcttgatctcctgacctcgtgattggcccgcctcagcctcccaaagtgctgggattacaggcgtgagccaccgtgcctggcctggccattgttaccctttttgatacagttgtgaggagtgaaaaatactcacgttcaaaaaggtacctttcaaggcagagtctccctcctaagagataaggaatttcagaaacacaccaggaatcaaggtggatagagagtttctcacctcctgaaaattacagtctaaacttttgacttcttttaccccagagtatcttaagtttgggaggaaatgtttgtgttttctctaaaagaaaagcacagaaatatcttctgcctaaattattattatacaacttgttttttcttcttttgaaacctctgtggcagataaaacttgtatgttaaaaaggaatttaaaaagataacacttgcaaaattttgtgaaacctaatataatcttctccaaagtgtaacgcattagttttccttaaagtagaaatggtttccatttactcccttcaagataaaactaagaatcttaggatggtatgcaagttcttccatgatctggatccgagatttggatgctagcatgatgccataaagcattgccagccccgtaagcctatttgtagtttcttaaacatagccagatctttcagtaatccatgttttttcatttacagtattcttccttctgaacattcattcttccccagtcattcaagttagctagttactgcctatccttcaaaattcatcacaagtatatgctttttaaggaggtgtgttctaaatgtctccatctcccacatctgttaaattactggctcttaatctgtttaaagcatcccttcagacctgtatcatgaagtttattatcagtgttacgtttgcctttttgctggtctccacaactcatttgttcatgacttgagaataacgggtcttcatatcccaagaccaggcacacaggggactcagtaattggtcctgtttagacttgcggattgcacccaatacaaaaccatgataagcaatgttaaatgccacagcagtgccagagaatcagttaataaatgcatatgacagattattatatccatagcagaagaggttattttaagaactactgcttgttttgtgtctgagtaaagatggaatatcaaacataatttctttacgatcaaacgaagcttatttccagataggaaggcattttttttccttttttctttattttcagtaaggaattaaattagaaaaatcatttgcatttttacatttgtcttctctgaatatgcagggctggttgaattctgtctgacaccttcacagaactcgcttaagtaagctttccattactaaataaattgcatccattctaattaaagatatgtagagcatactactcggacaggagaagcaaagtgctatgaagagctagagcttccatggtaaccctgctagggataatataattgattcaaatggtctctcctgccacatactgattccatgccaacaagccttgaaaactgtccatcatttcacagagctagttatagaccaagtccagctaagacaaataaatggtgatagaacttccagagacaattactacaatgaatcatgaaagacactccttgctttctagctcatttagtgattgattaccatcaacaaggtttaaataattatgtagtgaatatatgagtaatttacagaaagaaagggaaatacgtgtatcaattctttttgtataggggatctgctgtgggagaaataactcaaaactcaaatggtataggcaccacattaggcttaatattggtacatcattctgcctcattgctggttgtttgcgtccaagcttgtcaggcaatgtgtgagaatattatgcacacataataggaagtgataaagccccatgaaaatgaagattcagaaagtgagaaaagcacagtactttttcattccccttacaacatattatagttcctctggtcctaaccagagtgagatagagaaatgagttgatttctgtaaaccaaacttctcaactctagtagctcatattcctgacattcgctttggttgctgaatttgtcagcagcactcgaggttgatcaggtggtgtttcactggaagattggtatttgtgcgtagtggtggtggtggcgggtacttgctatttaggatgccatttgcactaaaccaatttcatcaatatcctggttagactaacttgttcattcacttcactccaggtatttcccacactttaaatttgctcccgcattgctatctaggttacacttaatagcctgctgatttagaagccagtctctcagtcaatcatcaagttatcaggcaattcgtttagattaaacctagtggaatactcacattgagctctttcagcttatatttgcttttgaaaatcttgagatttcaagctttcatatatttcactgcctctttaacaaaatgttagcactatcttttaatatacttttttcaatatgtattggtacctaaagccataataaattcctttaataaaaatgcgccaatagattcattttcttcttttttgctgcacaatattatctcatagtgtcagtgatggaaatctgctctctatttttagagggtgggatgaagtaaagaaggcttataagttggctctaaattctagaagctgaaatccaaggatcattccaaaagtcggcaggtgatttcctatctttgttcttgttttgctctgaaagaattcctctcttaaatactaacctgttgaactactaccatacatttaaatactacctaaaactttctaccttttcccttccaattgcatttgatcatgccatgttctcaaccttcacagaattttaaaacagtttccagctatcccttaacacaagggatatttatgtgtgcatttatatattcaagtgatcatagaaatttagtcttttataaatctctatatacttttctatttttgtttaaattaaaatatagaaaggaaatagagcaagacacctttatacatactacgtagctatctacatatttattaacaatctttcaaattaaaaaaacacagggttgaaatcatatattcttttcttcttcagaccaagtccctccttcttcctattctgtccaacaggttaaaaacaatcgttaattcattatgcattatccttacaatccatttttgaaatagacacatattatctatgcatgagcaatatatcatactgtgagatttttttcttaatttacataaattctactctagtgtattattatgttacatcttatttttggtgttctacattaattttgagatttctgttatttcatattaacctagttaattgctttaacctgctgaatagtatctccttgtatgaatctttcactattttgaatactgttagctctaccttcaaaatatattcaaaatccaactacttctcaccacttccaggctaccactctgaattatcctgtcttgtttggattattgaacagtcttctaccgttctgcatgcttcctcttcagagaccttaaatctattctcaaaacagtcagagtgactcttttaaaaggtatgtcatattatgccactaacctatttgaaatcctcacgtggctttgcctctctttcactcaacacttccaacaatgctgcatttaagttttactactaggtgggagagtttctctaagatgaatgcctgtaaatgaaattctctctctttcatattattttcccaagtgattatagaaagatttatagtcacagcagtgacatataaactgttcttttaaagccttcatagaaccctagcacatagctttgtagacaatagatggcaaataattatttaaatccttcatccttcaagaaacagttcctgtattagccacccgccataactgtttttctatatctctttcagaaagattcatgcttggccttcctgtatagaaattttgtaagtgctttcatttttgcatcttcatgcttcttattgtaattatgtatgtctgctccccacctgcccacccccatcacccacttccccaccatattagtgctcgttctctggaactgggtcttcattgcaccctagtatctaagaagaaaatgagtatattcaaattggagatgatctactaccaagaacagaggaattttcttacatatgtaatccccttttcatatcaccatagttgctattggtgattgacagatattgctatttttttccattttatagatgacaaaattgagggctattattttcccattgataaagaagtaggaaaaggcagaatgtacattgtaaaaacgctacactaaaacctaagcatattttactcttgtctgggacatagaaagtgctttgtatacccttttactaaaaaacttcctaagataatactatgtaaatattgccatatttgattagccaatgtaagattttatttactttgatcatattcttaagtaaaaacagcctcaacaactggaaaaaaatacaattttcctgtcttttacccataggttgtgagtgtgtctctctgtgtgtggcagggtgggggtctgggggatgatgagggagagggagggagagggagagggggagagagagagagagagggagagagagagggagagagagagatcctatattgtgcttctagttttaaggtcaagtatagatcactcttaatttgagggatttttgacagttattgatggtttgactttcaagaataaatcaatgaaatgctgagaaacaaaaagcaccttaaagcttacttcgacaaagtggccatgaatgaagaaaatgagacattgttaatctgaagccataatcatatttttggctatagattaactacttactactcaccatattggacagacctactttgttcctatacaaccctcaaaactgattttcctccatgttccaatacctttccccactactcacagatacactatatttccattggtgacacacacacacacacacacgaattggcttgaaaaatagcccatttgttttcacaacaaagggagaggcacctgataagattgttgcaaggtatatgttctcagcacagcaccattagctctaggatgcaagccccagtgtgcttgcctctttgcttttttcatctgaagagtcaaagctcttgtttattgctactgaaaggcagctgtgggtgaaatcagcagtgtcattgtccaaagattctggcaatgggtttaagtaaacaactaagggatgttctgtgccttcgttaataactaaatgtcggtgtgagagaagggacgagatgtcatttcttccagttaccccactggctttattgaaaactcagttttgaacaatgattctctgccttttcactgtcacccaattaagcttgaagcttttattttaccttttcaagatctctatacctctccaggaggaacaggacacaatagagggttttcacagcattgcaggcagatagtagatttgtaatgattagcaatgacacattctattttgggactagatttatcattcatatgctttcattctccaggtagtatttttactcaacttttaaaaatacttggcattcttggctcattcatgtacatagaaaagatatgtagcattactcccacccaaatcctttcaagttatgttgaatgttgtcactgaaatcatgtgtcatgtgtaacagagctcaaccactgagctgacaattcctgcagatgagttaaagtttgaattcactatattgatttattcttagttttaaaagccaacttgggcttcatatcttgccaaagattacctatttataatcattataaccatgtcagtgggtgcaatggaattgggtcttctcagccattttggaattaccaaggaataaattaatgtttctacgactcccagctttattttctgtcaacagctattcattgaggaggagtaagtattaaattgtgagacgccctggagatacagcagtgagcgcaaagagacccagtaactcccacatatcaccaatggtctagcatggagtcatatattagtcaaacacatgcatatttaagtaaatcattgaaagtatcaacaggctgcaaaagagacaggagctacaggagcctaagaaaatggaacagcaaatgttgaggaaaggggaaacatttcaaaaagttatcctaagtaaatgttgtatgaccttgggatgtatgcaggatgtgggaatggatggacgaacagattttccaacagagataacagcacatgctgaaatatgtagtacttggaataagaacaggacagagaaaactctgccatggacagaggtcattgaaagagacagtatggcaggccatgagcccagtgaggtaaacaggaacattcaggacatcacaggccatgttaaagactatggcttttattctaagggcaatggaagatatagatgggctttaagcaggacagtgatctgaccaggtttatgttaaaagaagaatcactcatattaaaattgaggatagtcatatcttgcattgacaatatcaaaggagcagtataatgatccaagaggaccaataagttcaaagtaaaaagataaattccaagcatccagtagagttaataggtgcactctcagggtataattgtagctataagagtatctgcttcaatctattattcaaaaacatacatcaatgctcaaattttacaattcttcacttaaaatggagcaccaatagatgatcccaagatttagtaacatctacacctgcagtagcctttaaatctggttaataaagatgcctattgccacttaattgttttatctactgcacagcaagctgaacccatggctcaaatctgaattatccatgaaacaaaataccagaaactataaatgaagtattaccacacatcctttgatataaccattattaaaaccttaaagataaaatttattagcacatatttattgagtgcccacaatgttccagatactgtgtatacaacagtgattaccaccatttgaattgtgtctcccaaaattcatatgttgaagtcctaactgccagtacctcagaatatgactgcatttggagacagagcatttaaagaggtagttaagttaaaatgatgccattagggtgggctctaatccaatgtgacttgtgcctattgtcagaagaagaaatctggacacataaagaaacacctgggatgtacacacacagagaaaagatcaagactcagcaagaagtcggccatctgcaagccaaggagtgaggtacccaaagaaaccaaccctgctgacaccttgatcttggacatgcagcctccagaactgtgatcaataaatttctggtgtttatgccacacagtctgtgatagtttgttatggcagccctagaaaggaatacatttagcaagttataaatctttttttttttctaacagtttacgatctggtggggaacagagataaaggtgcaaaaagagagagaatagcttctttgataaggggaatataaggtgctatgggacacctacccttaatttcggggtcagaaaatgatcactggagaaatgtatctctatgttgaagtctatgtaggagtagcaagacaaaaaaaaaaaaaaaaaagagggtggaagagttttagaaaaagaatgcatgcaattactcatgcaaaaacccataagacaggatgacagtgtgaggatctggatactttgcatggaggggatcactaagtgagtatttgctgattttttaaatagatttatctattacattgtggttaaaataccttccgattttacctggatttatgcaaatgcctattcattggttttcctgcttccattctctgtccctactacgctgtatcaccacaacacccagagggttcattaaaaaatctgaattacatctagtcactgtccttaagtaggcttgggggcttcctacagcactaccaaataagcaaatacatagataaataagcaactaaatatattaataaataacctcttacctgcaaagtttgatatgatctagctcatgcctacctctcatacctactttaattctactctctgacccaccctacctcaccccatccccagccacatgggcttcttgcagggccacaagagcacgccgagctcagtcctacctcacagccttgtacttgttcttccctctatccagaatacactttcaccaggtttttgcatgtctatctccttatctcatcacctcctcagaaagtctctaactcacctgtctaaatactccttccctccactcctctatggaattatgtattgtatcaccatcatttattttttatgttaaatagcatttatcctatattaaaacatattaagggcttttttctcctatcatctctctttctacccaaactaaaatttaaactctatgggagtagaagtctcatctgattgtatattgcaaatcaaagtgactggaacacagtagatattaaataagtatgtgttgaatgagtaatattaaaccatccaagttgactctgattgtaaattcatataatctatcctaaacatgaaacagggaacaatgggaagattttgaaccattcctagaaagtagagacaaatgtaatcccatggtacaaaaaaggcagcattaaaactacctcccagattgatgtggaataacttgtagcatgttaagcctgtgcctgtaagaacacattgaacatttaccgtgtgctcacatatcacagtgaatcagaaaggacagaattgatccagagaatttgccccagagaatttgccaactggtattgtcatttgattctgagtaagatgcttaaccatataaagtgtactgtaaattatggatgacaacactggccacatctacatcacatagagatagtttgggaggtaatgagatttttacttgaaatagctgagctccctggggagaaggcagaaaggggagatgaaataaattgcagccaaataccattaactctatatatttacaacataatttacactgatatactaagctatcgtgtcattaagaggggcgctttgtctcttttctgcagattgcctcccttattgatctccatttatttatcttctacactttatggaacagggtttcctggggctttgtcaatacagactttcagggttgacagacagtactagaagcaactgggtagaggatagtactgccacaaaggcacatctagcccaaagggtaatggcattcagagttttggaggcatagatttagatgaaagtgttgcttaaaattggagtgagagaggtgaccaatattgttctggttaaagggtgttcatggccaaactctatttaccagactatgagagcaaatgctgggtgatttaagtaggagtcaagacagaaccaccagcaggaggtgggataaatgttaacagagaatgctccacacaagactctaaggctctacaaagggttctgggcctagcagaaaataagaatacaaagatgaagagtatatagtacaatggttaggactgtgggctcccataccggaatgcctgtatttgaatcctctgtctcttccacttcctaagttaagggacctcaagcaattgacttttcttctttaaaaagaagattcaatttcttaatctccataagcgatcagtgctaaaacatatagaatgattgcgaatagcaaaaggattcacatatttaaaacatctagataggattcagccacataaggaatagtaaattttgtttttcattgtcattgtcatcaccatcatatcccttatcaaggtactagattgtggccgtgaagcttagaccgagagattagatggggcaggtgctgatggagccaaccagaaacatttcaaaccaggtgccacagatttaactgtggaatatcagatacaaaagtctattggacaaatgagtgtgtcccaagtgccactaaattatggaacctagttttccaataattttgctgaccaagtcaaaactagctcaaacaagtgattgagtagatacaactttgggagaactgggacaaaccatgggaacttgatgatctaacggtcatcaatcaaggaaaaaatatcacacttgtctctttcaaaggctatattttagtctgtaatgggtcgtataaatatggggaaattactttttagtagcagataatgtagaaacaataaagaaattaactaacttttcagaaccttgtggtttgtatgcaattgcatttttcattatgttcttgtatccttgctctttcttaaggcggaattacctttcctcttagacaataaagagaaattgaacaactgctgagacaatcattttctttactaaatagacatgaagttcctcaaatagtatataagagagatgatctttgttttactgtttatggtgccagtcatctggcctctaaattgacctgcaagcagggctatactttgaccactgtttatattccaaccagatgcaagtggagttatgaaagactgtcataaaaaaaaagaactcaggaaaatgctctccatattctctgtatctcctgttggcaaaacacataatttcccctgttgtgatacaccttaatcaaaattctcaatgcatttgttaattcataaaatatttctgaggattactattagtcacacatgtgtttggcaacaccaaggctgcaatgaacaaggaacatttagtcccagccttacaaaatcctactttctagcagattcagtataaacagataactaaggaacatgtacattttcattcctcaggtgagggaggggacacgactaacatttttagagtgtttatggtgccagacaccacgctggacactctatagatctttggaggggcagcttatctttttgcaggtatactcagtcaactacatcaccactgtagctgcctatctagcctcaaaatcttcaaggaaataagtccacaaagcttgaaaggaacaggacatccagaaagctctacacatactatccttcctcctgcacagtgtaaactttgaattctcattttagtagctaacccaccagagagcgataacttcattttgctatgggctacaggaggtgaagatagaaactgcattttggaggcaatggcctgaaggtaggttatttccatgcctagacttagaacatgttatctttaaacagagcaggcaggagaaggaaaggaaggaatatcaattgatgccattgccttcacaaatccttgatgaactgctcagtagggactaaataattggtaatagctattgtgtttattgtgtatagctaaaccagaaatgagtgttcatggaaatgtcattctataaccaagaaaaaaataaggaacaatgatcagtttgacattttaaacaagaggcatattttcatttggttcaataagaaaagtttctaagcaacgtttaattatattttacaccagatttcaggtgtgcttaattgcagtattaacttctttaccaaggtctcctaaaatacacttggttactattctgagaatgtcttcagtctctcttcatgaaacttggtgagacaacaaacaaatgatatgtcatcaaaattaacttgttaaagggaacaagaattaaaattataccttaaaaacttttccatttctgaaaagaaaaacaacgcacactattaaattcctggctcagaaggtgaaccaatatgaatcctttcttgaatctaatcaatcattttggcttgcttgggactataaggttttgtggacagtggagtttcagtgttaaaatggcagggttcccagaaaaccagaatgagttagtcaccttcctctcttcatagatttgtcgtgataattaaataaaataatgtctatcaaaggcatatcataaaatactttgtactcacaagcattgcgaaatgtcagccattgtcaaagtacttactatgacaggtgtggtgctaagcagttagttttacaagagacctttctgctcctgaatatctcagcttgcataatggacgtcagggacagctcagagaggggaatgagtggagagcaatagatatccttttctctgggacgggatgaaaggcatttacatacaaaattgcaatagtagggacagctagagagggctgctttgagcctgagaataggctcctgagaaagatttcaggtgtgctgaaagatttcaggtgtgctgaaagaaagaatgagggaagctagtgaattatctatagctgagtaaattataacggattaccatcactaaaatatatttattttatagtctaaaagcaaatgttatattttacatatatatgtaaccatatataataaatatatatgtaataataaatatatataattttaaaaagcctcaactgttccacactaactatacctctgaatctgaattttctaggctgtatatgacataagaagtgtccctatttcataatgaggctttcttcaatgagtaagtgagataatttatgtctatcacttttcatgttttaagtactcaatatacccatagattattatctttttatctttttataacagttttattggggtataatcaacatatcatataatttaacctgttaaagtgaattatattgagtgaattcaatagtgttcagtacatgcacagttgtgcaacagtcaccacaattaattttagaagatctttgccctccaaaacatccttctatccttttagctattaccctccacttttccccaacactccaggcctaggcaaccactctagagaattgcctatcctggatatttcatgtatatttcatttaattaaaattaaacaatatgtagtcttttgtgactggcttcattcatttagcataatatgatgacccatgttgtatcagtaaatcatttctttttattgctgaataatatttcattgtatacatgtaatatctttatttataacttgatagacatttgggttgttttcatcttttgagtattataaataatactgtcatgaacattcatgtgcaagctttatgttgacatatattgtcttgttttttttttttctttgagacagaatctcactctgttacaccagctgaagttcagtggcacaatcaaggctcattgcagccttgacctccctgggctcaggtgatcctcccaccgcaacttccttagaagctgggactataggtgtgtgccaccatacctaactaattttttttatagagataggggtttcaccgtgttgcccaggcagttctgaaagtcctgggctcaagcaatccatctgcctcagtctcccaaagtgccgggattacaagtgtgagccactgcacccagcacacagacatatattctcatctctatttttttttaaattatactttaagttctagggtacatgtgcacaatgtgcaggtttgttacatatgtatacatgtgccatattggtgtgctgcacccattaacttgtcatttacattaggtatatctcctaatgatatccctcccccctccccccaccccacaacaggccccagtgtgtgatgttcctcttcctgtgtccaagtgttcttattgttcaattcccacctatgagtgagaacatgcggtgtttggtttttgtcctggcgatagtttgctgagaatgatggtttccagcttcatccatgtccctacaaaggccatgaactcatccttttttatggctgcatagtattccatggtgtatatgtgccacattttcttaatccagtttatcattgatggacatttgcgttggttccaagtcttttctattgcgaatagtgccacaataaacatacgtgtgcatgtgtctttatagcagcataatttataatcctttgggcatatacccagtaataggatggctgggtcaaatggtatttctagttttagatccttgaggaatcgccacactgtcttccacaatgattgaactagtttacagtccccccaacagtgtaaaagtgtttctatttctccacatcctctccagcacctgttgtttcctgactttttaatgattgcccttctaactactgtgagatggtatctcattgtggttttgatttgcatttctctgatggccagtgatgatgagcatttttttgtgtgtctgttggctgcataaatatcttcttttgagaagtgtctgttcatatcctttgcccaatttttgatggggttgtttgtttttttcttgtaaatttgttggagttctttgtagattctggatattagccctttgtcagataagtagattgtaaaaattgtctcccattctataggttgcctgttcactctgacggtggtttcttttgctgtgcagaagctctttagtttacttagatcccaattgtcaattttggcttttgttgccattgcttttggtgttttagacatgaagtccttgcccatgcctatgtcttcaatggtattgcctaggttttcttctagggtttttatggttttaagtctaacatttaagtctttagtccatcttgaattaatttttgtataaggtgtaaggaagggatccagtttcagctttctccatatggctagccagttttcccagcaccatttattaaatagggaatcctttccccatttcttgtttttgtcaggtttgtgaaagatcagatggttgtacatgtgtggtattatttctgagggctttgttctgttccattggtctatatatctgttttggtaccagtaccatgctgttttggttactatagccttgtagtatagtttgaagtcaagtagtgtgatgcctccagctttgttcttttggcttaggattgtcttggcaatgcgggcccttttttggttccatatgaacataccttgtgtatatttttgggagtgaaactgctgggtaatacagtaatgctatgtttaattttttgaggaactgtcagatatttttccaaagtaaatgcatcattttacattcctgccaacagtgcatgaaggttctaatttctccatatacttgccaacatttgttattatcattgttttttattatagccatcctagtgtgtgtgaagtggtatgtcaatgtggtttttattttcattttcttgacagcagatcatgttgagcatcttttcatgtgcttattggcatttttatatcttccttggataaacctctattgaaatcctttgcccttttcaaattgggttgatataaaatactattaagtaatttctatacttagtcagtacttaaagagtacctactatgttccaaatactttataattataatcactaacatgtaaaaagtaatccttcaaaatagtattgtaatttccatttagtttatgttgggacactcaagatcagcataaaaaggaaaaacttactaagctaacagaggcagatacaggattaggactaatgttcagctaacatggaaacccaaaaagctcagtaattttttgatgctaggtggccacctgagcacactgaagtaaatgaactcatcctctcttctgataccttctgtgatcctccaaattttatcaggaacgtgccctaaatgcacatctttgatgctcccctaacgtggagaataaaattcacactcctcagcatgccactgagacctacccatacttgatatgctccaccatcccagcctcacttgacgccattccctaaccctgtacatcactcagctggaaaaccacaagtttcccagtgtcctacaggaaatttgcacttttctgtctcctggaaaaattctactgattctacgggcagctcaaaagtcttcatcagctgtgctaaattcttcttgtcccctgcaatcacattcctttccctcttcagcacacatactgttccttaattcaaccagtactgctgtgtaagtgtgatgttcctgatgtgtacaaagtaatggaggcataatagtggacatagtccggtccctgacactaggaagctgaaagtctagccagagtctgtttccactgctatcctgtaaactgtctgagcccagggatagtatcattaacttttatcacctcaccagcaagcacattccctggtaaaatctagattacaaaaaaggtatttctgatattttactgagactaccaacactcatacatcttgcaggagatagactcttctgctaatgacaataaatggaagggaactctggcaataaactgctgagaactgcacagcagcacttcccagctatctgccatatgagaattagaacaaaacaatgcaacccaaatgggaaggtggaagtgcacaatgaatacacaaagctataaactaagtgataatttttgtcttgattgtgtgagctaactattaagaagattataattaagagttcatttcttatagtaccaacaagcattttaatcaaccttgatagcattagctccaattaccattagtaaactataaagattctgttttaaattgcaatgagtcaataaattcaagatggcactttaggagtaaatgttaacaggaccttgtcattttcctgagcactcacaagctatggatgggggcttcgtgaaggcacaagcaacagtgggatttacgaagcgctgtgagcttcacaaacgctgtttgtactctggtgtgaaacgaaaaataattacccttaagaatgtttgataactgtttgatctatgaatttttagcttcatagctttaaagaaagacattttatttagccaaacaatctaatagactaacaaactcaaaacaaaggctgacaaagagagtcatctgaaattctcattattaacttacaacatttgcataaatttgaacagagatggatggctttaaatgacggtcactaattaagagaccgaaacaaacaaaagactaacaaaacattatgtacaaagacaagcacattagcatattctatctcatatctcccttaaaatgacatgaagacaaatattcctgattacacctgaagcaataatgtaactaaggcaataaatcacttgaagaaacctaagggggcttctttttaaacacattgatttgggtattaggactgtcactgaaatataaacataaaatggaatcaaatttgttgtgatgatgtatcactgaaacgtttgcctctttcctggaaaaatttaatcagtaggtggacatgtgactataacccagatgtatttgtttaaaaagactgccagattattagaaaactctctttcaaatgtccatcagaatagacatttatccctagtaaggcacatcacaggattgaaagtcaagtcaaaagtggttaaatgcttgggtgttgcatttttttgcttcccttaagagaagatctagaagtttttttttcaatgaatttaactctaaagtcttatttttaagatgtgtaacaaagttcacattgtgtgggaaaatttgacagtagggaagcaaagaaaggatagaacactgggcagagtctagctataactatgcaggggtggcaccacccattttcagaaaggccaccacaaagagacatggcaagaaagaaagtcccttgttggatgagccacgggaaatctgtgatgcaaggatttcagtatctcagacctgatatccattagcaccttggtacgcaaaacaaatttgttttacagactaatggtaataactgacataaaccctgaaaatttcaagttatttagaaatgaatttttttcaatcaaaattttgttctaacttttccaactattagaatcacactatgatgttatctgttagaatgttttgtaattttcttctctaatgtgattatccagttctccactgccatcattgaaatttcccaccaattctatgtataaaacattttacatttaggtaaacttaaaagacaccttagtagagtgttgataaacactccaataattaatcttgtaaatacccagaatatgcagaatctgtataaaaaatttatggtccagataccctgatcaaatgtctggataattcattcatttaccaagtgttggttcaatccctacttgcctactgcgtgaagtgttattcttagggaagttacttattttccttaaaatcaacatctacttttttgttaatctactgtgcagtctttagagaaaaaattatgaacctatagaatgtttcagattctttcaacaaatttaagaaaagagaataacactgcatggttccataataacaatttcagtactaccatcatttgcataaaggcaatgtctcttttactatataagaaggaaaaatatatctaaaaattcagtgctccttcagaggccacagtatctactatcctggcaatctttacagttttctcacttcttcgggggacagtctaccctctacttcttcagcatctccctatccctgatagacacaacctcagagtagttaagtgacccagaactgaccaatcagaagtttctgcattcctggtttcagtgattaattcaaaaactaaacatatttaaaaatcaatcatggccagtcaattttcactgggattactcatatggaacccagtataaatatgctgtcttatcctgcaatgttgctaacctgggaatgtagggctcctgtgttccccatgctacttttaaaaagctaactgtcataggctcgaacaagagcaatatacactgggaaactgagaaatacatgatggaacactgatagaaagacagtcctactctcactgagttctagttctgttctccagatgcctgctccctatagatcatcctttgacttgaactacccacaatgtgcttcctagtaatatatgtcaataaacttcacttttaattcagggtgtacattttcaccctgtaactgaaaaagtcttgattgacacttctcctttaatgatgttgaataaattagctctcatgctttggcattcttttattacatttccatttattgaacattgactgggctcacaaagcactgggctcacaagcactgggctcacaaagactaagccacaatccttatatttaataattaaataacatttaattatttgataatctttatattgaatatagaaaacttaacacgtgtggggacccactcagaaccccagagttggtatgaagattatttgatgctgaagaaatttgaaattcgacaaatgcagaaagaaatcttcttaaaacttctctcatctgagcagaagcagaaatttgtgagaaataaggcttccataaatccctttagggcaggtctactcccagaagagaaaccaagggtaaactaccacagattccctcttgggagagtttctaggccaagaaagagtggaaaaggccactcctacctccatacacaaacattattatcatacatcttttaatcttctgtctgttttcctaaaaatctatttgtctttcctaaataaaccatctgttcttcctatagaagccttttctcccccacccctttcctttagtaacttaggtatataggcctctaaccttagtcacctagctagcttgctagttcatttattagttctcctattcatgggaataagccttttttccccctttaatccatattttgtcagtttagttcacagacctcagagagcaaacttaagagggtaccagaaaagttttcctccctgacacacataaaccattaacataataaaaatttgtatattttatttaaaaatgtatagtataaaaactgtatattgaggaaatgtcctatagagacaatcacatacacatatgtcatcatcatcatcatcattatcagcttcatcaaagggcttcttttaaatgatgtgggggtaaggtaatcttcaaaacaactataatggatcttgacaaaataatttcaaagttctgaatcacttatttggtttaaatgagatttattcatcacaaattctttgggtctcatctcatccaaattgatctcaaatagaaaacatgctttttattctgatcatttactttacgtaaagggctaacacatgtatacttccctttgcaggcagaccatgctgaatactatatatatacatatataagactatgtagagtctcctatatatagtctatatatacatatataagactatgtagagtctcctatatatagtctatatatacatatataagactatgtagagtctcctatatatagtctatatatacatatatagtccttctctagaaatacatacaaaatatcagttcagtcttccccaatatgactgaggtagtcattcttattatccccttcttaaaaatgaggatcctgggccgggtgtggtggctcacgcctgtaatcccagcactttgggagaccaaggtgggtggatcacctcaggtcaggagtttgagaccagcctggccaagatggtgaaactctgtctctactaaaaatacaaaaattagctgagcatggtggcagatgcctgtagtcccagctgctcaggaggctgaggcaggagagttgcctgaacccgggaggcggaggttgcagtgagctgagatctagccactgcactccagcctggtgacagagcaagactccaaaaaaaaaaaaaaaaaaagaggattctgatatttaaagtagagagataaactatcaaaagttagagagatagttcaggatggaactaggtcttgtcaaagtaaccaatatcctctgggtgggctcaaagttgtcactatgactcttacaagaaaacaacagcaagggggtcagagtcagagatgaagctggaatggtgaaagcagtgttggagtaatgagaagccatgaactgaaggctacggtcagacttcagaagctggaagaaggctagaaaacagattctctcttagagattccagaaggagcccagccttgctgacaccttgattttagcccagtgaaatgaattcaaatttctggtgtgcagaactgtaaaaaataagtgtgttattttaagctgctcagttggtggaaatttattatagctacaataggaaaccaacagaatctcacaacatcttttcccagtggggaaaataaaaagtaatatttacatggcatctgccttggcaactgggggtgttctttcagaacctatagctgaggcaaaaaaataaaaaataaaaagaagaattaagaagatagagtcacatattcaggcctcattagaaattaaatctgaagcaaaagcccttatacttgatatgctaagtattaataaaagttatatccaaatagcaaggtgacaaattctggaaaacctttcatctgactctgcaatatcaatttaaaacactccattgatgtttcaatattacaaaatgccctggaaacacctgggatgatggagacattggtattaatatttttttccatgaataatatcatcacatttatcaatagcatactaagagggagagcatcaagataaatagctaatgtatgcagggcttaacacctaggtgatgggttgataggtacagcaaaccaccacggcacacatttatctatgtaacaaacctccacattttgtacatgtatcctggaacttaaaattttttaaaaagcataccaaatcactgagtttttttacaggatccttcaaaacaagatattaaatatttactaatcagtgttaataaatattctaaatatttttaaatataacattgcttctgcctgatccaatgatctagagttaatgaatttgatgatgctatcaaaaagctaaatatggcaatagaccattgatcactcttgctatgaaagaatggggactataagtcaataaataagtgggggctcctgttttcaatagttcgctgcccttgagtatgccatttttccctaaaagggattgaagatgggtgatggactatatgattaaaattcataaaaatgacatgttattctaagatgactgggtacagaaaatctcgtcagctcttacttaagcaattttccaaaaactggaaggaaacacagtcacacacaccgtggggtcacttcctgcagagatgacttggggacatagctgaatgaggctgaaaagtcagacctcacaagttcattataggtttagctgaggctggggcctgtcggactcttttttgtttgtttgttttttggtcaaggttaagtctgggtaagtctattcaggtatgttttcccagaatttaagctaaaatgatgaaaactgcctttgaacttgaaggttctgcggtaagtgcacaaattaaaagacatctgaaggtaggaagaggagacgttgcctttcttcttaatttgaatgttcagaaaaaccagtaattagattcattacgttaaaattgaacttaattcctttaatctgaaaatttcaaagggctttcaaaagctcacaaattgctgttaatcccaatggcacaaagatgacctatgtcattttaatggtatggtatggttgaaataaaaacacaagagtttgattattcctctgagggttcagtttcgttttgctctcccataaattaatttgaagagaaaaatcaacttggtgtcagtgattaagcaataattttaatgcatacacatgcacatgtacgtttgcatacagagtgaaatttattctttaaatagctgtagagaatctacaaaagcagagtacaaactacccagagtgaatagttagtatcaataaaactcatattccatttttactgtggaccatacttctagcaccagcattttgatcccaaacacaaaaagcacactggaattcctctctctctttctttctttctcactttttctctctcgtaatctccttcttgctatcattcatagcgctagagaattttagactagaaaagacttaagaaatcacttatttactagttcttctttttatacctgtgtaaactgatcaatcaaattaaagcaagttgactgggtaaatggagttgctagttaggaaaataggaattaatgcctacaatgactactgtcatctctttcaaaatctgtttaaaaaataattacatagtttaggaacacatagtgtggcaaaagggttttctttttgtatttttccttttgtttctatcacatagcatccatctttccttctcacgttagcacctcaacctagattgtagggaactactgtcccaccacaagcccaggcccctccagggggcttccaggttgaggcatgtggctcagaagtctaaccactcagagcatggtgttgccttggccagggtgtaggttctgttagggcatgtggtccaaagagggccaatgaggcatgaggccgtttcttctgaagccactggccaggaggtagctgctcttccccactgagactgaccctcacaggatgtgatgcaggcattgtctgcaaccacctagcaccacgtgaagccagaaaataaagccattagagtagaagccagagctgagagattaaatggattcctaatgacatattaaattaagttccacctgaagcccagaactaccacctgggcctctcaattatttgggccaagaaattgtgggtttattttttgtttttgttgaagccagtttgaactggcttttaagtcactcaagtactaactgggcttgccagataaaatacaggaggcttggttaaatttgaatttcagataaacagtgaataactttttttttttttttgagatggagtctcacactgtcgaacaggctggagtgcagtggcacgatctcggttcaacccaacctccacctcacaggttcaagcaattctcctgcctcagcctcccaagtagcggtataaacatttcctatgcaatattaggaaaatctgacaattctaattctaatcatacagcaagctatttctagacgtggagcagggccagtagagaaaggagagagacccatgacaatagcacagagacaggtgctgtcataagaagtagtaaggtgttgtatatactttcctggagaggagaagagctagttagttattacagtgtcatagagaaaaggcaatatatttatcaagctggtgttccaaatccctttttcctgctctgatcccatctcttccttggattcaacctcaagtcctggaattcatccagtaaggaaagaggtagaaacagcctctatgtcaatcatgacccactatgagttcagtttaattcattgtattccattaggcatttgcagacattgtgcagaacattgcaggggagcgtgggtgaaaaggtcctaattgccctattctaagggctctaatatgtccagaggaacaaatataggcaaagacaacaagataactgtaatgcctgatggattagtatggatggtggggggaaaggccaactctgaaaaaggtgggagttgagctagaccttggtggagaggtatagtatgtggggtgggtgggagtggtcatttcaaacacacgtcctcttgccatttcctatttttctttctgttcctctcctctcctctcctctcctctcccctcccttcccctcccttcctcttctcttctcttctcttctcttctcttctcttctcttctcttctcttctcttctcttctcttcgttctttctttcttccttcttttctcctgcttttctagtaattatgatgttgtttatcaaattagcatcaagtgcaaatctattaatgggggtgtgaccaagcatccaactggtgctggattggttagggctcatgaatatataattaaaattctataagggttgcattcagcaaatatgtagaattttaaagctggaagagacctttagcaagcccctgattttgtaggtgagagaacgaatgtgagatcaggtaactggtgatagttgcagatctgggactagaaaccaatgaagttatgctcagcatggttgctcgtgcctgtaatcccagcactttgggaggccaaagtgggaggatcacttgaggtcaggagtttgtgaccagcctggccaacatggtgaaaccccgtctctactaaaaatacaaaaattagctgggcatggtggtgggggcccgtaatcctagctactcgggaggctgaggcaggagagtcgcttgaatccaggaggcagaggttacagtgagctgacatggtgccactgcactcagccaaaaaagaaatcaatgaggttgactctagaatccaagcttcctcacctactaaaggccattaaactagcaggctttatgtcctgattttgttctctattaaagagtaccagggggaaatatacagctgaagtttattttccattctccatcagtctagaataatctcatttggatatttctcaaataaggaaaaacatggactttctctttaaggaatgacgatttgtgaagactgtcccattttacaaatctccgatgcccatgtacaatgggaaacccaaggggctccccaaacacttccatttgtctttttctggggcagacctattaaggtgccactgttcagaaaactcagcagcaagttaatttgcccatgttgaatgtgagtctgctgaacttggggtaaattgatatttccctatttcagatataaatgtagcaagaaaaaaaatccctttcagattcttaaaacacttggactgatttgctgagaaaaagccagcaacagggaattaaggagcagagtatcccatctgcaatgagatgtacagtgtaaaatcaggttatcagtgaaaatgagtctgatgtgctaattcatagcacattccctatacttacgttgtgagcccattatataatttagcaagattctggggcctttctcaagggagggcaagttctagaaaacagaggttctaggcaagcatgaggaaagtcctttaatgaaggaagaagtcaggtctatattttccaaaagcccatgctatttatacctctagcccctgatgttttaatagtgaaagaatggtgctgattttgacttttccctgaagcacacactttcacatgcaaggaaatgaatctttagcatatcctggatgaaaaagcaagaaatgtcctattaacttgaatgaggcattaaagggtctttgatgcagttcaacttctaaaacgcatatactttctcctccaggttacttatggtagacacattcttaactcctttgaaatgcagaatgagaaaaaattatttgtcttcttcaaattcactggctagatggattctctgcatgtacttcaatttccccaaaccttagtgctatattttttaaggaagtggagttattcaaaaatgataatacactcatggttgcaaattcagatttcttcagtggaagcataaataactatttcttccgtgaatagaaaaatgagtccgtgtaatactttgtctcttcatattatcacagttgtggatattataccaaatggtaacacagaataggaatagctcatcctggacttctgttcatagagaaagacaaagcatttagctgctaacaggccttgtcaattccccaaggcttccttgtaggcgggaataactccattcttttgctggtttcctaacaatggtagttgtattcataggctaactctcttccttttgctcttgccctttactgctgtattctaaagttttcagctctgcaatgaaaccttcagcatgaaacatccacacaatcccaccaccaaatgtctcacctgtacctgcttacacagcttgctctctctggtcatagatgcacaaccaggatctgatcttaggcctactttttcactgttctctggatcccacctcctctgaatgatgtacctgctctcttcttcatcattattcttccctcttcactggattattagcatataagcattctataatacatcctattttttaaaaaaaacaaaagacttccatgggtcccctcatccctgtgtagactgagatgtcctatgttctttataattaagttcttttgctctggcatcccttcttaggcattcctgagcccacaagcccattccagtgagactgtggtctacaccactctattgtcatgatcaccaaagacttttactagcacttatcttattgaactgatcagcagcatttgggagttggtaactgtttcttccttgaaatgtcttcttcccctggatacagtaagatactcttgacaaagctttctgtctccagggtgtttcttctcagtctccattatttattaagtataagcttaaataactttacatcctggaaggccccaagggctgtccttaaatctctgttattgtccatatccacacccattgaaattatattggctatatttgaaatatatctagaacctataaccaatttccactgctatcatcctagtcaatgtcaccatcttctcacttccatacaattgaaataggctcctgagaagtggccttactgatggttttgccacctacagtctagtctttcccaagaggccagatctatcctttaaaaatacgtgccagatcttgtcagtcttccatttgacactgagtataacctcattcctccacttttcatctagaataaaatttaaaatttccacatgatccactctgcatcatctctataacctaatagaacgacttccgtgtccttcacctaataccttaatcaattcctgttgctatgaccaaataccacagactgcataatttataaataatagacaattatttctcacatttctagaggccaggaagtccaagatcaaggtgcaacagattcagtttctggtggggacccatgctctccttccaagagggtgccctgtttctcctctggaggggacaaatgctgtgtccacacatggaggaagaccagagaggcaaaaagggactaaggtgctctgttctgcttcttttatacgagcactaatcccatccatgagggtggagaactcatgacttaatcactctcccaaaggcctcacctcttaatactgccacaccagagattaggttccaaccttagaattttgaagacacacaggcattcaaaccgtagcccatactttccggtagccatgctggatttcttgctgttccttgaatgctccaagcacactcccacctgtggttcttgctctcacagtttcctctgcctgggggggctctcccagcagatatcagtagcttgcttctccaaataactcagatatcatccaatacatttgtcccttgcatcctcattactctctgttctcacccaccagcttcatttttcatagtacttactataacaaaaaatttcacttgtttattatttttttcctgcttcttttagaatacaagctccttgttagcaggaatttattttattctcttccattccctcaagtctagaacacttctagttccttagtaactgcttagtaaatatctatggttgaatgcatctccatctctgtgatataacctcatccatatctaccttccttactgccttatgatgcctctggatgtaatttagattttgagtattttttctattcccaagtattccaaacttacacacacacacaatatgagcttacacatacacatcatatttttataaacatgtacacgtatacatagcatattaacaatcttcaatgatttattcaacatctaatataaaaaagtattattatataggattgtagacaaattctaagaatgttaaagcaattaaaagctattatgttataaaccaaccaataagtaaattgtatacattattttagtgagaaaaaaattctggaatgatggttaaatattagtctgggacagatggcaactgcatatgatttgctacatatccaagaattaactggtaactacactatgacattagttctaggataactaaatcttttttaatagctttataattgacaaaaattctttgcttgaccaaactttagtcaggcttttgaatcttctcctaggcctatctgtgcacttccttgtaaaaaccagttttagcaagaaccttgatgtcagtttagaaggaacaccccactcacactctgggttcatctgatcatcccctcaatatctaatctcatcctccatcctctgacctctcccaggtctgatcaccctggcctgccttcagcaagacacttgttaggttggtttggccagaatcccgtctccctgaagttcttagtaattttccgtccactaacatgtcacctaaccctggctccttaaatctaaatccccactttctcatgccatgtttggagttgagctcagtctctctcccccactgcaaaaatctcattgctttggtagctatacccatcacaatggtcatgaataaaatcttccttattgtgcatccttattgtgtatcattgagtaattctgtctttaacataactaaacaaaaaaaaacctctgacagtttgtcctttaaactagaacctctcaaacacgtcagcaggtatttctttcctattattggagcccggtatatttggcaaggcagtgcttaaggtgataaggatgaagactgcagtctgtggattcccacagaagtgactatgtgccactttctagttcagcaacttgcttttcctctgtatgcttcctgagaagtcaaagaaataacatcttttaaacacccaggatcatgcatgacacatggaaggacctaataaatatcagccattatcattatcattgctatttctgttagtccaagtattagcttcaaatatgtaaactgcatatagtttgttggggcagtctgaggttgctctatctcatcatcagggggtctcagtccatcacagctagtggcctgtcatcttttattttatgttatttatttttgttttgagacagagttttgctctcgttgcccatgctagagcgcaatggcgcgatcttggctcactgcaaactccgcctcccgggttcaagcgattctcctgcctcagcctcttgagtagctgggattacaggcatgcaccaccaagcccggctaattttgtatttttagtagagacggggtttctccatgttggtcagggtggtctcgaactcctgacctcaggtgatccacccgcctcagcttcccaaagtgttaggattacaggcatgagccactgtacctggccccgtcatcttttaaactgtaaagacagaggggccttgctctgtagctgaaagtcaatgcttctcggcctcttgcagctaagtagataatgtgtggctgaggaaagggaaacttactgaacttttaaagactatttttggggaaaaatgtcaaactctttaaaagagaggcattaaaaccctctcctatctcttcctcctaatctaatagtgcaaaaggcataaataatagcatcaacaatataggaatattttctaactgctagcattgtagcagtggcatcaaacagcactagtaaccactgtgttcctcaccatcacccacgggcaaaaagcaaataggccagtttcaattagtaatatacataatgaagaaaattatgacttttattaaatcacaactcgagctcatctttataatattctttgtgacaaaatgggagagatacataagataatcccattgcctacataaatatgacaattatctcaaggaaaagcgctgatgtaattgagttttgtgctgaattagccatcttgttcaagagccaatatttttacttgagagagtaactggcaaactatagttattcagactcagatatttggcagcattttcttaaagatgagcaaagttagcctgtaccttcaaggaaacaattgagagtattcgtgaataatgatgaaatctgagctttcaggcaaaaattattttggaaaactcatatctgctaccaggggcttggcagttttgtgatacttcaagtctttactgacttttaggttgatggttattttaataaatactgatttttgatatcatagaacaaaaactttgataacacttggaaatgtatataacttagtgaatcaatattttccaacattatgcatagagaaaagatacattcaaagttcaacatagaccttaaatgatttttatgaccacaatgatatatggagtgacaaggatctcctctcatcttttctgtgtttactgccttctagcaagattggactcttaatttatattttgctttgttttatttagtatgcctcttggctctactcataaaattccctctgcctagagaactttcccccacagagagtcacatggcaggctcacctcattcaaatctctcaacaaatgcaccctccataaataaaccatccaggttagccctatccaaagtaacttccctctatatctttattcttcctcattttactcataattgctgggcatttcctaatacatttattaaatattgctagtcttttccaagggaacgtaagtgccatgaagtaggaaatttgtctctttttttcactgtgtgttccacagccttgaacagtgtctggagtaaattatgtactcaacagatgtttgttgagtgaatgaatcaatgaataaataaacattgtaagttctaatacactcagggtgagagcagctaaatatcttaagcaaactcacatagctttgttggctaagctagaattggtatcagtttagtgccagaacctaaactcttaactaatacactattgcacattttgaactccctaaaaatttacaagtatacattccctcatttccattgccactttttattttagtcagataatctaatttaattgagaaagtcctgctttttggtagacaagccgtccctctttcaattcatacagttaaggagaaaaagaataaaagttatagtcagttgtaaggaaacttcaaataattatacagatataggctatcaggaatgctgaaataaatttgctcatgcattgcaacattggccaaactgatcaatatccacaggctaaaaaaataaacaactgaatctctctaggccacagctgtctttctatggataatttacagagttagaaaatagctcaaaacacacaaaggctctatagaatcagaaaaccaaacgaagccggtagacattgaagacttccaatatttttggtccatttcaaaatcttgtgcaactttttatatgtatttttaaaccaaagggcaataagtgtcttctaggagcaacaaagttaagatttgtattatccagtaatatgataatatagaaatattgacattcagagccttcccaaattctttgtcacaattttatgccctccaaggaaaactcagtgtcaagtggttattgagggtagcctgttttgttaatcaggagaatgttcaaagagacaaatcgcaagaatgaatttagagcaacgtaaattataaagattctgcaaggaggcacagaggagaaagagaagccaaggaaatacaggctaaggattttgagagagagtttcagaaggagaaaaagagtagagtagtgacattagggacagctcctgtggtgtgaaggtttgaggagagaggtttcaggatgttttgctgtgtttcattgcaaagtaattgttttcagtgcaattgtttcaattcaatggtttcaatgcgatgcaatttaattaatcttttagactttttttgagaaatgttattaaagccaaattactttgctctgttatgtttagacttggaattatatttcttttagattcaacaaccaagttgtgggtcttgatcagaaggaagcctggtgtgattctcgttacagtgacttgctgaggaaatttcatcagtggagtctgatcagatatagtgttgacacaagctgtatttctttctactatttcacttttaagtaatacttttagtaaaggttagttcacaaaccagtgacatcccaaatctgtttctttcttctatgatcttgggtttcactgtcaaaaatggcaaccacaggccccatattgctattgggcactttaaatgtggccaatgagactgagaaacttaatttttatgttatttggtttatatttaaatttaaaaaaggaacacatttagttttaggaaatcttcaagtttttttttgttttttacttttttttttcttttttagagacagggtcttgctctgtcactcaatctggaatgcaatggcatgatcatagctcactgcaacctcgacctcctgggctcaagccatctccccacctcagcctcctgagtatctgggactacaggtgtgtgccaccgtatctggttaattaaaaaaaaaaaacttctattttggagaggcaggggtctcactatgtttcccaggttggtctcaaactcctggcctcaagtgatcctcccaaggcactggaattacaagcatgcacccagcctcaagtattattttgaatactatgtttgtggatccgcttttctgaactgtaaattttgtaaaatttcaataaagatcaagcatctgtgctgaaaatttaccatatgaattaaaataggtaaaaaaaatactgcaacatttataaacagtgcagaaaagaaaaaataatatgttattagaaatgttatattgaagacatgttgaaataatatactttggataattgagttatgaaatattttaatctaatattcattctgtcgtgcaacaaatgtttaatgagtgcttgctataaaatacatcgttaggaaaaaaggggtcgataaaattgtgctgaactgaatataataaggtaaaaataaatgtatgtgagtgtatgagtgatgggaactgaggggaccatgcatgacagagatatgagtcaacttttcatggggaatttgagattctagtttgcctgtcatcagtcctgagggttttgaatgccagaccaaagcgaagaggaagagtctctgtaaagccatggaagcagcatgaaaaacaatgagcatgagaagagtaggaagacctgcctggttgaatgggaacatattttgggaacgtgaaaagagcagaaaaataagcacaatttgtaccaattgcagttgatggcactccttctacgagagtacagtaaatacactgcagagtttaaaaagcctagaaagacatggaaaataatagtatacttactatattttgttcaaattaacaatgagacccatggctttgaattcaaaagtgttctacctaaagagatactggagactgtaaaaaaaagtatataaagcatattactagaaattgtgattaaagttgtagtgttttaaaatagttctgcaaattctttgacggtcttgccttgcacaggtgttgcttgcttcccctcccctggaatgtaggtcagacttaatgatctctttggaaccacagaatgtggcagaattagtattctatgacttgcaaggttatcaacgggatgtagcttctgcctggtttttattcctgcatcactgtctctgggggaagccagctttcatgttgtgaagacattcaagcaacactatggaaaaacccacatagtagaacggaggccgcctgctggaagccagtaccaccttgttagccatgtgagtgaaccatcgagtggatcagccagccacagttaagcctgtaggtggcagaagcttggaccaacaccttgactgcaacctcatcaacaacaccaagctagaacctcccagccaggccatttctgaattcctgacccatgtaaaactgtgtattataatcagtgcttattactttaatgagttatgtggtacttatttttgcagcaataaataactagtaaaagcatgttatttaaggagaaatttatcctatgttttctgacctttcagatatcctgtaggtacctgaagtggcaaatgttgggatgagggtactatcttggcaataatggtctggcaacattgacaaagggattggatggcccacagacagacaacactgaaaggtgacagggtctattttagtctttcaaggtagaggtgacctggagaaaggcaatggcagcagaaatagagaaataaaagagatgaagcctataaatgccaggaattattcattcaaagacgatatcacattttttgagctagagtgactaattggtgctgccttagagaaaaatttttaggtgcttaggaagagaggttcgattttagacagtgaaatttagggtaacagatgtcttgaggctggaaaaggggcaaagagtttgtgttgatgtaaactgaactttgatgtaattgtcaagaggctttcttgggaggggtttgttgatatttactaaaaatagcaggaaagcaaacttttagatagtgagggccattgatcaatatttggccagtgagttggtttgcttatgaaaccctggaatcaataatgatggaaaatctacccatgaacctttggctgatggttctcaacaatgttacagaaagtaaatgaagttctataccactgatattaacagaaacagtgaagaccaaagaaaatgtctttcctcagttcctgttaataaggagtcagagttggccaggcaaattggctcacacctgtaattccagcactgtaacagtccaagatgagtggatcgctggagcccaggagtttgagaccagcctggacaacatggcaaaactccatctgtccccaaaacaaataaacaaacaaacaacaacaaatacttagccaggcatatggaggaatgtgcctgtggtcttagctacttggggggccaaagtgggaggatcacttgagcccaggaggttgaggctgcagtgagccgtgaccatgccactacactccagcctgggtgacagagcaagatcccgtctcaaaaaaataaaagaagtcagaattatcttaccagtttttgttttctatttcattcacattaagtagttaaaatcttgccctctgttcattcattttcatcataaagctccttctagcatcctcatcaaaggaggaagaggaagagctacagtgtactgaaacaaattatccccacgtatggggcacttgacatactcaatttctcttagctctgaagtactctaccatgtaagaaagggatgcttaccctcactcacaaatcagaaaatgaagtgtaagagaaatgaattgtccagagcctggattggaaacactcaagcctctagtctaaccattttgtagctctttgacagctgcttatcatacacacaaccaacagtcattctcccctttgttcctgctcataccatgttcttacctaacctgctgcttgaaaacctgcgatcccattgcatctcatgaaaaagccctctgatcctttccatggattccacatggattccctttccaagctttctccacattcttccttctttcttgaagatttctgctacctcagttcctcacagaaattcatctgacctctaaattaagagttggtgacacatggcttggcagtgaagaactctggattagccatttattagtactttggttaattgacttgactgtcttctggaaaacagggagagaccataacttatgctgctgtgaatttcttcataccttgctgattactggcaatcaattgcttttatatgtgtatttgattttaaaagatccaaacttgaaattatgctcagaaccatctcatttgtttctatgatatgtagatgccttttaaatctgtctatagcctcatactgggttttatttccagaaactccaccagctttcttggttaacaaaattttccacaatggtgcatgtcttttatatttctatgttaattttatatggtgttctgctacttttaacatgacttttctccattattccctggaaaactgcatcctttaagattgtaggtcatgctgacattggtatacaagcattcctctatcccttttccattcatgtagctactctgtgtttagataggagtgaacatgacacattgcctcagggggagcttcactgctataagccagagaacactgatatatctccttgccccagggttatgtgcaggactggcaagtagcccatatatatgtcgattcactgatggcatttcctcgctacaataactggttacagaattggcaggggcctcaggtggtcaagttagactaaccatcatatttttatttggttgttagggggaggctatctcttgatgtagacaaagtggcattagggtaagtagatgtgagacgtggtactgacagaaccatttccaagctctgagctaagctaggctgaggttggaactgccacatggaaaaggccagactcaggaaattcatcgagaaatggccatggaactttgatccctagccctgaagtctgctttacctctgggtgtttttagctacatgaaccaataaatgcttttaattgcttaaacctaattgagttgagttttccattacttgtaactgaaagcaccttaaaaaaatccagataaaatttaactccctttgtaaagccctctcaaatctctacaggcaggtcagtttactgacccttcttttcttccccataactttgctcatacagcactcatcccattggaagtgttgcactgcaatgaactgttttataatctgtttttccagcacactatgagttcagtaagaacaggaactagatcccattcagcgtcacatccctagagtgttacacattgcccagttcttttaggaggcatcaataaaggaaggaatgaatcttcagctcctttaccctggttcttatttcagtccctgacaagaacccagatattcaacagctgaggaaagttagagtttacgtagtgtctgaactgttgtattgcagtctgcagcagttcaacctatttatcacagggttattagtctttcccccaaaccacttttaaccaagtcccattacactccaagtccttctgaaattacttacagcttctgcagaatagaccatttttatgtccattcatttatttactcagcaaatatttatcctgcgcctacctgtgtcagtcagtagtgtaaacacacaacattaacgaaaaaatcttggccttacattctagcagaggaagttataaacaaaatctataagtaaatatagagtaggttagatgatgatatgttctatgaaaaaaaaagcagcgaagtgaaacagaaagtactagaggtggttttattgcaattataggcagagaggtcaggacagtctcaatgagatggtgacaactaaagaaggtaatggagatgtatacatatcttagagaaaaaaagtattcagagagagtaaacataaagtgcaaagactaccagacatataaaacaatgtccatagtcattaatcgtcaggaaaatgcaaaacaaaatcacaatgacttatcacctcacatgtatcaggatggctattatgacagaaaacaaaagacaagtgttgacaaaggtgtggagaaattgaaaccctctcaggctcctgtggaaataccactgagagagcagttgctatgataaacattatggaagaaccaccaaaaattaaaactagaactaccatatgatacagcaattcacttctgggtatttatccaaaataattgaaataggatcttaaagacatattagcactcccatgttcattgcagcactattcacaatagccaagaggtgaaaacaatctaagtgtccatcaatagatgaataggtaaagaaaatgtggtacatacaatggaatattattgaatctttaaaatggagattctataatttgtgacaacctgaatgaatctttaattttttttcttttttgaatatttaatttttatgggcacatggtgtatatatttatggggaacatgagatattttgatacgggcatacaatgcaaaataattacaccagggtaaatggggtattcacctcctcaagcattcatcatttcttttttttatgatcattctaattgtactgtctcagttgttctaaaaggtaaaacaaattatcgctgactatagtcaccctgttgtgctatcaaatgctagatcttattcattctacctaactatatttttgtacccattaaccatccccattcccccccagtccccactacccttcccagcctctggtaatgataattctactctatttgaaggagtcttaggacattatataagtgaagaaatacagttacagaaagacaaatactgcatgattccacttatatgtgggtacctagagtaatcacattcatagaatcaaagagtggaatgaatggtggttgccaggggctggaggaaggagaaaatgaggagctactttctgtccatggacagaaagagtcagtaaaaatgaataagctttagagatctgttgtacaacattgtgcctttagtaaataatattgcacaactaaatattgcatatttaaaaaggtaagggacacattaggaggctgaggcaggcagatcaccttaggtcaggagttcgagaccagcctgaccaacatggcaaaaccccatctctactaaaattacaaaaaaaaaaaaaaattagccaggtgtggtggcgcacgcttgtaatcccaactattcaggaggctgaggcaagagaatcacttgaatccgggagacagaggttgtagtgagctgagagtgtgccattgcactccagcctgggtgacagagtgggactttgtctcaaacaagcaaacaaaccaaataaacaaataaaaaggtaagagagtagttctcattttaaatggtctcactacacacacacgtacaaacacaaatggacacaaaacaaagaccctggatggagcacctggtgtgggagaggaaaaaccaggctggagagaggctggagcagagtgaatgaagaggagatgggtgggaaagatatgggatgataatatcagagagataaagcaggtcagtaaaccactgaactcttccgacgtaggcattttaatcacggtaaaatgagaagcttctgtaaagatttcacagacaacacaggatgacagtctcaccatcagaaggctggaaggcacagccatgtgcattattctggggctaagaaaagcagttgctttagctccacatagggaggttttatttaattaggatttgaaagtcatatcaagtggctctatttctttctaacaaagcccaatgtatttaattcctataaatattttagctaacctgtcagtcacatactttttaatataagggtagtggcacataagtgaaaatggaatacacaaagagtttcaaattatgtgtaacttggtagagggattaggaggcatcttgtaaagatgtggcatgtctagtgtttcactttgttttccctaagagaagactgagtaatagaaccacctttttattttctccttctgcaggcctgctgcctgtgattgatagctattaaattaggttttacctccccagattggtccagattaaatacacttatagcacagcaagccactgagaacaaaggaacaagtggcaattactttgtctattttggtcttcttcatagttaaccatcatttaagcattcaaaggaaaatggttggaagacaggaacgaaaggaaaatgaatgaaatgagaattaaacacatttcattgtaagttcctcaaatttataaatataagcttgcacacaagcatatttcttaagagaactgacttcaaatgcagaagcaaaagaggaatctcctggaatacataagtttattgaggtgatttgtagtataaccatctttcctgacctatcatgggactatatgtcagtcatatttgaaaagaatttatttgggaagaattccacttgttcaggactcagacagaagacagaatcacatgcttcctagacagtgatgccaaggttattactttgaaatgagtagggtcaaagtcatgctgatgagagaaaaatgcttttctcatgtgaaattgtgttctcttaaagataaataaatgaaatcatatttgctgtttcaaagtgtttgccttccgtgttttgtaaggaaatgatggcagcctccactcttggaaaatcgaactgggattgtagcacccatcattcttctctttctcaagagatcagggtcttcactccctctcactctatgaagccagtaaagtgtagacatagggaatccatatttcacatactgcccaaacataaggtcgtgcagagcacaagaaaagagagagactgtatttccatcacatgttggaaaattatgtttcttgaggtgtgtgtgtgtgtgtgtgtctgtttgtctgtgagttagtgtgtctgtgtgcttagtgggtccagggatgcaccagataagggacttaggtaaaggtggtaagaagattaaaaaaaataaaataaaaaataaaaaataaaaaaacatcaagaggaaaatctgtgtggttatgtctgagggtctcgtgtgtgaatttcctcccgttttgtggcattaaaaatgagttagttaaataaagtagcatttgcaagttcttctcctctgttctattttcagaaagggtcagaggaagctcatgatctcctggagagactcaatcagagctggatctggctgggaggtcacattggcccacccgatgtttgttactcaagggagagaatgctccagagagcacggtgtttttagcatgagatgtcatgaagtagtcctcggatttttctccctttgtggggcagaaagtagagctttgccatatttgctcacagataataagggacatatagaacaataaagaattccacttctacagtagatcttgggacatcagctagggtaggagtcactgtgccaggacatacacttctgggattgcctctccttcccagaaatgtgtttctcagtttggcctaagttggacattgtatcagttgaatggaagtaagtatttaaagggaatgcagaagcaagatccaatgctctataatgttggattgatctatgttttgggggcctccatgcagaaactcaaatagtagaacaaaggaattactctagaaagcagaatgtgtgtgtccagccttgatttctgtagccagataacttaagtctgaaactgtgaaggctctgtgatgataactatctatttgtctatcgatctacacacacactctctccctctctctctctctctctaacagggacataagacttctggatcatggatcagactatttagtcacagagcagcctgcatccgtgccttatgcccaaacacctcccgggcagtgcagtaagaaccagatctccctgtgcatataataggtattgtaccattaaaaaaggaaccccagttagttgggcatgatggcaaaagcctatagtcctagctacttgggaggctgagacagaagtattgcttgaacccagaaggcagaggttgcagtgagccgtgattgtgccattgcactccagcctgggtgacaaagcaagactccatttcaaaaaaagaaaaaataaataaataaaaggaaccccagaattatgaaacacagagattatatagggtgcttttccatctgtccctgcatcgctctggagagatataaagagacttttgctatgcaattttaaaaaatcatcttttgggagggaagaaagaaggtctttcctccaacatcctgccatgtaagcaaatgtcttcaggggagagaggaagtgtctatgtctccgaagctctctgcctttacacttttggacagttggggccattacagttgtccgtcaatcaccctttaacctgggtgctgatgttctttgctcagaaggctccaatcatacagaaacatgaaaatattcataaagagttgtttccctacaagagccagataataattcatctcttcagagtgtggttgtaaagtagaatgagattattcagggatggagataagaagtaatgaaaatcaaggaccagtcaaggaatagagaaagtatgtaattccttcagcctctaagtggaagtagctttgcctatgtagggccttctactcgggagttttcacctgtcctccataatgcactatgcatggaatacgaatcaaggttgatgcatccttctgctgcagttgccattctgccatattatattttcctgttttccatgcttcattgagattgaaactttcctatttatgactatagtccaagctctagcatcaagcatggtacttggaatgtgaagcatgtttaataaaataatgacctatgtgttattcccttccatcccaaacaatagcttcctagctggtttcctagtgcatattcctaactttcattatgtgatatatacaccaggaaaatgatgatgatgatgatgacaacgatgatgatggtgatggtgattttggtggaggaggtggagattattgagttagggaggccaaatttaatatcgcctctattattaagctacttgattttcaaaggtgttgcttctccacctataacataaataataatatcaattatatttaatacagtaatatctatcttaaaataactaaataaaattatgtaggtacagtacttagtatggtgcctagtgcccagcagggttgaaaaatgattagtgactgttatttatcattgttgattttctttttaaaaagcagtaaagcataggaggaaaagtaaggagagggaggaaaatattgagtttttttaggttaattctattaggctttgctccctgccaagtcattgttataaacaatccaaggagagaaggaatgtgtagaagagatttaggaaagaatattatgagaccaaatcctccaaatgaatcccagtccatgcagaaattgtactggcgacagctgttagatttgggcagagactaatgaagaattataaaggaggtataatgctgattttaattctgaatttgcacaggggtcattccaacgtcaaaaataattataaacaaagagatttcagttgtagttttgacactgtgcaagagctaggtcagacctctcatgagggctacagcctcccttatctctatttttacaatctgttctatgtatcctcacgaaatagacagacactgtatacctacttgtcaatgttggtgaaatgtcctaagttccactgaaaaaaacatatcaaaatattagcattactaaggaatgcattgcactggatatcttatttctttttctaattcaactgtaaaacacaaaattaaaatggcgaaataatgttctttgaatatctttgtatccctacatttctccccctcccactgccacctctgtacttcactgcaatctaggctgtcatcatcttgtttatgaactgctgtaatagctgcctacagggttttctctctcctgttttgttctgtcccctgcctccagttaatctattgtccacagcagtcagtacgatacatacatcagataaatcaatatcttgctgaaaagcattcaatatcttcctattagggagattcaaaaccctcaacattgcatagatcttccagttcctactctgatttctttgcagtgttctttatcatttcctgacactctaccctctgtttcatacatctttcccactctggaatatgcagtttcttctaagtggaataactgctattcaattttaagaccttaccttctgtgaaactactagaagaaaacataggtaaaagcttctcgacattgatctgagcaaactttttgatataatctcaaaagcaaaggcaacaagcaaaagcagataaataagattaatttaaaccaaaaagcttctgtacaggaaaggaaacaatcaacagagtgagtgaagagacagcctatgaaatgggagaaaatatttgcaaaccatttgataaggggttaatatcacaaatatataagaaattgaagtagttccatggcaagataacaaaaagcatgatcatataaagagcaaagaacctaaatagacatttctttaaagaagacatacaaatggccaacgggcatatgaaatgctcatcatcactaatcattaggaaatgcaaatcaaaaccacaataatatatcacttcacacctgttaaaatggctattatcaaaaagagaaaagatagctagtgttggtgaggatgtagagaagagggaacacttgcacactgttggtgggaatgtaaaatggaaaacagtatgaagaatcctcaaaaagttaaaaatagaactatcacatgatccagcaatctcatttctgggtatatatccataggaaaaaaatcagtatgttgaagagatatctgcactctcatgttcatggtagcattagtcacaatagccaggatttgaaaacaatccaattatccatggatggataaatggataaagaaaatgtggtatatatacacaatgcaatattactgagcctttaaaaaggaggaaatcctctcatttgtgataatatgaatgaacctagaagatattgtgctaagtgaattaagccaagcacagaaagacaaatactgcatgatctcacttatatgtagaatcataaaaagttgaactcacacaagaaaactgtagaatggtggttgctaggggctggggtggggatggaaagctattggtcaaaggataacatttcagttaagataaataagttctgaatatcttatgtgaccatacttaagaatattgtattatatatttgaaaattgctaaaaagaccataaatgttctaaccacaaatacacaaaaagataaatatgaggtgatagatattttaattagcttgattgtgttaattatttcaaagtgtatacatatatcaaaacatcacctctatatgagaagtcactcttcattctggatcaatataggacctactgaaactgtcatttcctccatcagaattcatatttcttctatcatattacttttttcaatattatctgtagtctctgatacactaacaatatcagttatttgcacctaacctctctgttctatgagacatatctctgttacagaaaaattggaaggaatgaaaagagaaagagatgatatttagcattttgtttcataaacactaacttgaagctcacagcctgcacacaatcatgaaaaccaagatgccgaaattacagacagaagtattttatattataaaatttctgcagcctactttttttttttttttttgagacggagtctcgctttgtcgcccaggctggagtgcagtgcagtggctcaatctcggctcactgcaacctccgcctcctgggttcaagccattctcctgcctcggcctcctgagtagctggaattacaggtgcctgcaactatgcctggctgatttttgtgtttttagtagagatggggtttcaccatgttggccaggctggtctccaactcctgacctcacgtgatctgccctcttcgcctcccaaagtgctcagattacgggcgtgagccaccgagcctggcccacttacctttttaacaagccataggatagagatgattggcaagattgctttaagggaagatctcataaagcaatcttgggggtgatgcttcaagtgagagaaagcaaggatggtcacaacattgaagtagttgggggaaacatcgtttatgtgtgtgtttgtgtgtgtgtgtgtgtgtgtgtgtgtgtgtctgcatatgtgcttgattcctacttttcatttcgtcacctgggaaaactgcaagcccagcagagaagctactatatttaccacaatgtaacacagtgccacacggacagaagtttacaaactgagaagccttacttagagaactatggcatggagaaagcaggtaagggctccagagtcccaagaaatgttgtgaccactggttgaccagaagatactacgagttaagatgaagaagtcacagaatgcaggaacttactaccatatctagaaccttagacttcagtaatgaatgccattacataccaagaaaaaacaattatgcccaactttatctcagtaggctacagttcaacataaccagggcccagatgggaccaatcacacttcatctgatattcttggaagtcaagagatagcacctggacaagggaactctcttccaatgatgagatgatcagtaatatttcttttgcactcagacgctatcttagataggtaggaggaaaagcaacaaaacccttttacaataagagacaaagtcttgattgtcactttcaacattagactgagtatttatgtaaaaggcactaagttgaaaaataattaaagcaaaagaaactgcaaaaaacataagtttgagttctattgctactaacattgcaagcgagaacgtgagttcacttaaatgagatataacttctaaatttccattttgctctacttacagaatgcattgttcctgataaggctcatttttttccatatgtaacattatacctagcacaaagaagctgccttctatacatttgttgaatgacaaagtaaatgagtaactaatgctgatttaggaaaggtaacaaattagtgattaacttctaacatgtcctcttaactgttagccacaaatcactatttctacacctcctcccatctctgttctccatgtccatgtcacaaagttcaatccaactgattttttttaatttcacagaattttaaaatatcagccatatgttttcactaaaatccatagagacaaaaccatgctaccagccagcatttgctctttgtttcaatgtacagtatcctatatttgagccatatgacttatgagaatttttttttttttttttgagacggagtctcgctctgtcgcccaggctggagtgcagtggtgcaatcttggctcactgcaacctctgcctcctgggttcaagcgattctcctgcctcagcctcctgagtagctgggattacaggcgcgcgccaccatgcccggccaattttttttttttctttttgtatttttagtagagactgggtttcaccatgttggtcaggctggtctggagctcctgacctcatgatccacccgccttggcctcccaaagtgctgggattacaggcgtgagccaccatgccaggccgagaatttttaaaaatgtagtgtttccttattttcccaagacttgatggaggatgggtaaagggatgcataaaagcacatttaccttttgtactagaaaaggcctggggtccatatctggactatctgatcttttccaatatgtgtaaatttcttaaaaacaaatgaggattggctgggcatggtggctcatgcctgtaatccctgcaatttgggaggccaaggtgggacgatcacgaggtcaggagttcgagaccagcctgaccaacatggtgaaacaccatctctactaaaaaaataaaacattagccaggcatggtggcatgcgcctgtaatcccagctactcaggagactgaggcaggagaattgcttgaacccgggaggtggaggttgcagttagctgagattggcaactgcactccagcctgggtgacagatcaagactctgtctgaaaaagaggaaagaaagaaagaaagaaagagagaaaaagaaagaaagaaagaaagagagaaagcaagcttactttttttaggttcatctcacaatattcttacaaaatataagatttctacaaaacctaagatttataaaatctaagaaagctgaaaggcaaactcaagcattaaaaagtggaactttagaaaatcacagaatgttatccatttctccactattatatcattttaagttagcagatgtcaatcaaatattttccagataagacagtcatagtgccacatgttggaagaaacaaaaactgggttggacaatcctgtccccaaatgtgcataggctattttaatgtattttttatttttcaatgattcttcataaattctttgtccttcacaacaaagttcttttggcaaaacactaaggagataaaatgtattcagtacagacatgagataggacaaaataatatgatgggggaagggacattggagaggagaggagaaatgagcactcgggagagaggaaagaaatagaatgatcctcaacaatctatttttacttgacctttgaaggactctggttatatattcttttctctatcttgccctaacccttctaaaattattaataaaataaaattataggcataaaatactacctaacttaactttaaaatcaatattatgagagattaacaaaatagccaattttcctaagtaatcttaactcaattaagcacttttcattaaacattttgacttgttaggggacaactaaaactgtctgcgataataacactatagtattttttataatgtgaatcagcaggacattaaaacctaactttctctaatcttcctaaacatcatatctgaagtgaaatatgtgttaaatatatatatgcacataaagtggtaagaatttatttaagtaaaagtaatcctttaaagaatggagtatgaaaaaataaaatgaatatgcaaatttttggaagatattttgtatattcaaattacatatttgaacgtatatgcacacgtcattaacacatatatatgtcattaacctttactataattctttcagaagttatgatgatataaattacattttaaaataaaaaagaaactcttgtgaatgtcaaacacatttgccttcactgttgtactgcatgctaacatatcttaaaagtggccggacatggtgactcccgtctgtaatcccagcactttgggaggccgaggcagtcagatcgcttaagcccaggatattgataccagcctaggtaatatagcaggaccccatctctatagaaaaaaatacaaaaaattagctgtttgtagtggtgcatctctgtcgtcccaggtactcgagaggctgaggtgggaggatcctttgagcaggggagggagaggttgcagtgagctgtgatcacgccactcactgcactccagcctgggcgacagagtgagatcctgtctcaaacaaacaaaaataccaatgtaatatgtggaaacattattgagcaataaaaagaaataaagtattaagacatgctacaacatacataaacctcaaaaactttatgctaaggaaaataaagaggcacaaaagaccactttattgtgattcaatttacatgaactctccaccaaaagcaaaggcatagaaaccagagtagtttagtgaccgtagatatggacacatggagtctttcgggtgtgatgaaaatgttctaaaattggattgttacaatgcttgcacaactccatagatgtaatgaaaataattgaatcgtatacttaaaatatatacataacaatattatgacatgtaaatgacaccttaataaagctatttttaaaatctgaccatttactcttggataaaattgtcaaatatttagactacacagaaaggagaaaaatgtataacaacagaatacttaaattttggaaacatttttgtggtttttttattctttgaaaaagcaccctttccgaggagtatgtaaacatgtaacttctttaggttaaatggagaaaaatgtatcctttgataaagaggataaatcaacattaaacatcgtttaagggaacagtcagagttagcatttatttatttaacaaatatttattgagcatctactaagagccaggtcacgttttaagcactggggataaacatgtaaaaaaaaaaaattagttttaaggcttttaattttttctccattgtttccaaaccttcagtgaaactacacttaacttctgtaaaatccaagctgctttttaatgaaatattttaattaagcatgtcacttttttaacttttttttttttttctttttcatttaagatgcctttttcagatcattcccattctcattaaacttcacacggatcatgacttttctgttctcacaaatgcaccccaactcagtctcagggcaagaccagctctttttgtgcaatggtagggtttacctaatttgggttggaattttcaatacatgactgagagaatgtttcagtctacttagtaggaaccttaacaagaaaagtggacctcagtacagtgatgttatgctaggaaatgggtgtgtctgtgaggaaattttagaaaaaggtatgatttacttttcctaggaatagtcagacttagcgtttatttatttaacaaatatttattgagcatctactatgagccaggcaatgtgttaagccacgggaataaatatgtaaaaaaaaaaaaaattaaggcttttattttttcttcattatttccaaaccttcagtgaaaccacacttaatgacctttttagcagcattgtgactaattaaaaaagggaccataccaatggttgggaaaggctaatgaaaccaagtacagtcttccctacactgcacttcctccgtggtccctcagaggtagggtacagtagtgagaacttctaggggataccctgcagggagcaggcttggtcttcagcagaaacgcactctgagcaagggtaactcgaagggactgactgagaagcaatggtgctcaattatgaggttcagataaatcacctgcagactcattaaactaaatccccaggatccagtctcagaaagatgaatacagtagaaggagtgagtaggagctaggtcttgacatgataggcataagaactgtccgcgtagggcagaagcaggaaatgaatttcgaggaagagttagccgtcctctttttcaaagtccttaagaaaactgacagccagaaaccatcatagccaacatgaattctctttccaagttgtaaacaaataaaggcataccagctatataggtttatgaagctgtaggctgattttcatggcagccaaagtaagcataagtcatatgaattgttcttataacttaaaaaaaatgttttaaacataaattaagccgcaagaatggagggtaaaggagagagtattttttttattaattaaagggaaatttgatacagtgcttgagcagtgacaaatacggtaacctggagaaactggggctggcagtatctgagtgggcttttagaggggtaggactcggtcaaatggatggtaaaacaaaacaatgattattacaggcatagtgctgtctctgtcattttctcatgctgttccttctgagtcagagaatgacatcgtatagtcgtttttaaagtaggaattacttgcatgcaatcctttttaaatgtaatgtcttgttttgccagtaacacaattgtccagtaggctcattagaccaccaggacactgatagagttccacagctgagggaggcataaaagtcaacccaaataaaagttaagtttcttcaactgatattttttacataagaataattcatatgacttcaggttactttggccagcattaaaatcagcctgcaggcttcaaaaaccactacagctgacatgagggatgatgcccacaatgacacttggtggtgggaggaagctatcatggaatcgcaatatttgggcaatttacaacgcgatgcccatagacgcaattgaaattggtaacatccagatttcatttatggtggtatgcttgctgactagccacaaggaaagatgatatcctgtgatggaaatggtaggaatcaaggtgcacattttctaggatgattttaagcttagctaagcctgtacaataaggaggacagactagactcatttctgaaatgctatttgattgtttttatgaaatagactttattttttagagaagttttagattcacaacaaaatggaatgaagagtagagagttcccatatactctctgcccccacacaagcacctaccccattatcaatatcttataccacaatggtatactggttacaatggatgaacttagattaatacatcattatcacccaaagtccacagtttacattagggttcatgcttgatactctacattctataggttttgacaaatatgtaatgacatatatccactattatagtatcatacaaaataggttcactgccttaaaaatcctctgtgcgccgcctattcattgatttctctctactcttccctggcaaccaatgaactttttactgtcttcaaagttttgacctttcaagaatgtcatatagttggcagcatacattacacagttacacagtcttttcagagtagcttccttcacttagtcatatgcatttaaggtccctccatttcttttcatgacttgataactcatttttttttagcactgaataatattccattgcctggatgcaccacagtttatccattcactactgaaaaatatcctgtttcttccaagttttggcaattatgcataaagctgccatacacactcactagtaggttattgtgtagacataggttttcagctcctttaagtaaaggcaaaggagtgtgattgatggatcatatgataagagtatgtttagtttgataggaagctgcccaactgtcttccaaagtggctgtaccattttgccttcccaacaacagtgaatgagagttcctgttgctccacatcctcaacagaatttagtgttctggattttggtaattctagtgatgtgtgtaatagtgtcccatttttgttttaatttgcaatttctgaataacttttttattctgataatttataattctgcaaatttatttatttagccctcaaactgggaaggaaattatttttaaaacccgtatctttaattatttgatgatttattcttaccaaatcaaagttcctaacttttctttcaatacaactgtgtccaatgtaacattaattaagcatttttaatcctgatctttctgttcatttaatccagtatgcactgagcatctatctattatcagtcactgtgaagataaagcaatttcccttaaaagaaaattataaaatcatcatttttgacaaggctgatatactttggtaccaatgacaaacctaagatagtatcttgtgcataatgtttttagcattagcagaattaatgtggttttctcctcctctggacttttatcaggcttgtgtttttatctagtacaatttatttccctattgacatatcttttatcttaatgaactaaaatattaacatgattcaatacaaacagtagtctattcttgcatcacgttttatacttactagcatgtattttaatcattgccacaaaatttcaaagtgataacggcttttacaaattactttccttcaaagagaaggtaaaaagaagaaactctcccttgataagggagggtttatcagtggtattctattagcaaagtagaagagatcagaacagtatgggggggtggggtcatgcaattacctttgaggaagtaagccatatacccgctatcaacatagtacagccatacttatgacagtgaagaatcctcaattacatcaacctgccccggctcagttctatgggtgatgcttcaaaagccattttaaaaatatcactcaagtagatattagcataatttagccattatttatgaagggtttagggtatgtcaactgttcttcctttttaatctttaatccttacaatagcctccgaaggttaaagtcactatagataaaaatggaacactaataggtaagaaatctgagtctcagagaggcttagtaacttacccaaggtcattgaggtggctaagtggctaacctaggagtcgaaatccaaatagatggtaaactcagctcttttcacccacactatactgcttctaaattggatcatggaatacgagtgtggagccaaagataaaaatagttacgcaatttcaaataaatccaaagactttccaaaaaaaaaaggcattgatttaaggttttatttacagaaaaacttcaaacaaaacatcaaagcaatgtaaaaaatggaatggaatatgcttctggtgtgcatttcttaccagaactatttcattcaataataaaaaatatggaggctgaggttgattgtcacaaacttgccatgagcatttcttcaataatatatattgaattaaagaggaacgaaggagaagggcaaggatatccaataaatttaaaaaaaaaggaaaagtaaggaatatagaactgtgtctatgaagatacataagaacatcaaagaggaccatgaaaaattcagggaaaagttaagagtctgaagaaccaaaggatattctaactaaattcaagaaagcttttcttgagaacattccaaccacgaaaaagtgaaatatggaacaaatcataaaggcaaaaagggcataagcaaaataattatttttataacctccatagtaccaaccataattctttagtttgctttgacgtcgacccttccgaggcttgatgttatgaatatttatatactgcataatgatagcaaaagacattcataaatggtagtcaatgatgttcagacatttataaatgtagaactggtctccaaaggcaatttggtcatagattacatgctatgtatcccagaaattatccagataaggttgacatattaccagagaggtacagagcatgagttagcactaaaatgatgcagaatggggatacctaagaaaatataggaggatattcaaatagggattgaattccaagatagattaatattttatggacatatagccaatggattacaatgattaaagactgaactaccactgccaggacagattagtgtccacgaaccccatttctaatgagaaacacagatagggaacattttaggaaaaaaaaaagtgactaatgatcttaatcacaatgtttggtacagttgaccccaaaccacaatgattagtcatttaataaaaagctactgataaataatatttctctagttactgatcaataataatggagtgcaaatatgactaaatgccctatacctgccctattgttctcataatctcattaaagaacaaagatataagaatattcatagtgtattcaatgtgtgaaaatggaagcatatatatatatatatatatatatatatatatatatatatatatatacaatctcctagaagcacacacatatggtggcagaaacagtaacctaattgtttactggagaaaaccacatcaagacattattccatgtgaaactgaataactccaaataaagcgaggaaaaatgtagattaggttcaagttgctcaatgaataatcacacttatttctcccaagagcccgataaacattgttagtctacattgcttctcaatctttgaccataaaaaagcacctcaatttagcaaagcacaatggttcccacaaagtacttaaggaaatcagaattgattctacttatattgattttggggaagatatgtgctacaaatgtggaacaaaaattatgatgttcaacagtcctaatgagtgcgtctatttacaagtgcaaaacaaggagatacaatcttgttgaaattttagtatctctgctcaaattagctgggaaaaagaccagtaccaaaggcgaagcaaatgatttttctgcattgtgcttacaaatgatgctcaatgaatggaaggtgaaaaaccagacataaaattcctggaggaaaaatttaggaaggcaaattgatgtgtaatcaatagctccatcaatgtgcaccagcattcttggtaaaagcaaacaaataaaaaacaccaagatcaaagcaaagaatttaagagtagcaggctacaaacagaaggtaacatggaccaggtcagatagttgaaccacagttataatcaggctgattttttttttagtagtgccatcgtcattctattaccagaatagatgattatcaactccagcctaagtttcatttctgaattctgaaacaaggtctcttgcaagggaggcagaagaatctctagatcgaaggatcagccatacctaagtctttctgtcatctcaaaggttaaccttgtgtagtagattaacttattgaccccaattctttcacctatcataaaattgtgtaccaatattattgccttatagtaggtggagtataatttactatatgaagaaatgagattcgcttaaaccaacaggatattaaaagacatgatgcaagctgaagcttgaaatatacatacgtaactaagttttctgttatgatttagtgatcagccatcaaaagaacattccctaggaactgttgtctattcagtctgagcccaaggacaaaaatatatggggctgggtgcagtggctcatgcctgtaatcccagaactttaggaggccaaggtgagaggaacacttgagaccaggagttcgaggccagcctgggcaaaatggcaagacccccatctctattaaaaaacaaacaaagaaacaaacataaaatagacctaaactgaacctctagcctttagccacacctagctaacccgcaatgtgaagaagagctatagcttcagccaatttagatcagacaaaatgagtgtgagaataaatactcattgtagtttggagttggttctcagcattattgtggctatagctgactgatacacatactcctaggtgtcagtaattggtaccttaattatcttctcttctcaatcatgccccagccttctagtctatctccaataaccgggtttatcctctgctatagccaatttccttcctaatctgaatctctttagctggatatttgctaacacttgtcacactttcccgatattctgcctaatgaaacttactatcgacttgcttccatataaataattatcaactgatttataaataatacaagacaaataacaattattaatattatcatttgttaataaagagttacaggtcaggcacatttaaatatgtgttttgtttaactttcacaatactgcaaggctgattttataatcggtattttctgggttcaatttctttattctttactactatttttattccaggctctcagctcagaagtaacctgcccaagatatcccagacagctggaagagatgccaggattcaaacccagatgctgctattcatgctcttctatgtcacattgtttaaacctcagcatgacgttttcaagtagtaaaacagatattcatgttacaattgaataatttttaaggataagatttgtccattacatagatctaaggatactgataaaattccttttctcacctgaaagacagtataaaccatgttatttggcaagtaaggtcagaggcataaagagggttggataagggacaattctcataaaaaatgttatcaattgaatatattctaagaaaaattaatagtaaggttttagaatttgaactttttttctacctgggaaactgcctagaaacattagcatcatgtaacatttgagtgctgggactctgggaccatataggaccctctccccacccaggaccactctgtggcctgttaggaaccgagcagcacagcaggaggtgagtggcaggcaagtgagcattactgcctgagctctgcctcctgtcagctcagcggtggcattagattctcacaggagcatgaaccctgttgtgaactgtgccatgccggggatctatgttgcacgatcctgaggagactctaatgcctgatgcaacagtttcattccaaaacgatccccgcccccctccccacaaccctgtctgtggggggaaaaaaaaaaaaaaaggctttccatgaaaccagtccccggtggcgaaaaggttggggaccaccgatagagaactgagttcaaattctgtgtctaactttttctggctgggtgttctagataagttactgctttcttgacaccttagttttctcatctgtaaaacaggtctaagagaagtaataacttcatagagttgttgagggagttagatgaaaagtgtcttgtaatttagcacagtatccagaacaggtatattgtggtcatctcaaaacatatgcactgaaattctacagcatcattgaaaacaggggtcgctcttttctaaaggagattggccctttcaaagcacagagaaaggcagggactcatgaacaaagatggggagaaggtaaggagaggagcaaaaaacttaaattgttttgatatagtgtgttgaaaaatgtaaaccaagacatgatagagacatgcggacacgtgaatatatgtttgagggggtatagtgggtgaagctttttaaaagatatgactatgggttacatttcacataagcaaccagatgctattctagtcagtgggactaaggaagggctttgtttaaaggtggctagaagcaatttaaaatgcagcaacttccactttgtgctagcaagatcaatccatgttttgagctgctgttttcacctcttcattgtttatcaggtttgagtctaattgggcttgattggaatcatgggaagccactaattaaaatgattaacaatatcaataacagcaaagagaatagaaaagaaagcctcttatttttaatgggcagaacacggattcttggtgtctgaatgaatagaagttaattgaggactgacagtggataacacatttctgaaatgtctattttcatgcttttaataaaggcacattttctagaagaataggagctaaaccaaaattataaatacagacaagatttttttttctcctccactaattgaattaaagccaattcttaaccgcagaatgtttgcaggcaccttgttatcaacgacttctactggataccgtgcttaacactggttatatttcagctttgccactgacctttaaattgctctaatctgcttttatttacaaatgtggtttctgcaaatgagcgttggatagaacagattcgagacacactaacaggacacaatccaggctcaagcagaggaggaaacagcgagctcccagatcgtcttcttactattctgtttgacaatgtcaggatgccttatttccagaacacaagggaagtcatttagacggcacatttctctacttaaagtgttcactctctggctaaaagggggttcatcatgttgttcctgatgtctaatccaagttctgccttgaagtagatgagctcaatgtcaagaaaatcatgtgtttgcatttggatagtcttactgactgctgagactgatatatacctagtcagagcctgggaaacacctgagccttcctttccttcctactaaaatttaacccagaaggactctgaatgaaggcacaggaatgcttgataaagttacttaggttccaggaacttgaggttgccttatactttgcttattacatctttactctttttttggatatttacttcccattgatatctaacttctgaattatttctctcccttggtgtaaggataactaacatttgcacagaacaccattgtttctaaaatgcattccaaaaatcactacacattcccttctcgccacatctccattcaggtaaagcgatggagtgactttgtttaggaaacaggttctggagttctgtgaactgaattcaaagactgtctctgcactttctgtctgtgtaactttgagcaagttatttaaactctctatacctcatgtccattcctgtaaaatagatggacctactgagatcgccctgaagattctaaagagagttcttgtaaaggtgattagaatattgcctggcccagatcaattatccaataaatgtcggctggtttactacttgaattattatcactattctgtgagttctttcaggacatggtagcagaccacacttatctttggatacccctatgcctaacacagtgcctggcagatagcaggtgcttaatgaacaactgtgccatcgttttacaaaccaacaagtccatattctaacaccttcaatccttcagatggagccaggataggaaaacacattttcttattcaagtgcaatgcttttcctgccccagctatatcccatcaaggtgataacttatttattttgcctcatcccctggacatattagaatgctcagcaatggaaatgctccttccatacttgctgaattgaattttctcttttcaatgctgtcttctggtgtggcaaaaaaagcagaaggtaattgactgtttcactatgcctctctcactacattgtttctcaggcaccctatatattttttctttttaaaaaatatgtatccatattcctttagcacagctgttttcaacaacaataacaacaaaaaatttcaaagcaaggcatactttctttaaataaaatcttttccagaagccaatttttataacaaataaaaagcagttcttggatatctctaggaatttcaaaaagcaagactaatggagccttgaactcgccatgcagctgttcttcctccatttcccattccgttctcctaagcccctgaggcagttttgttgaacctttagggtttcagtgaacgctattttaaatccactgtctcaggcccagcaattttggatgctcctaggtgcaacttatatttaccgaacttctttgtgttagtggaactgcttccggttttcagagagagtaaattgaaatatacaaatgcagtattaaggatcttccaaagtggcttaactaaatacgcagtgatagtgttcctaagccagatggtaaagaaaccctaacttttttgtaacaaaataaaagggctgatacatctcttacttttaatcttgttttaattaaagctgcagtggctaaagtgattagccaacatgaagtcaatggaacttaaggttttatgtctttttattttacaagtgtgtgtgtgtgtgtgtgtgtgtgtgtgtgtgtgtgtgtgtgtttggttactgatctgaaggagaatactgatttaactttcatgctcttgttattttagttcatacatgtaaactctgttttccagcaataagttctctgagtcttgttatgatcataaaatattttgcttttgaatcattagatagtgtgccttgccagatattttcaaagcgtgtgttcatttaaaggcaaagtttctgtcttataaatctcgctagctcttcaagacaacctgcttataactatttacatacacctcaaagttcgaatgaggcccaggaaagagacacgagaaggccattttggtggtggggaaggtaatatttctttactagagctaaagatttctaaggattcttaatgcgatttttaagcaatctgctgctgtttaataaatgtatataaagttactgagctatgcaatatgttgtatagagatatgtgatctttttaaaacttaagccaatacagtgaattttgtcattttaataaaagtctagaataagaaatacatattactgtaacagattctttcctgtgggaatatatgattcaaatatgtcttttatttaggaatctttttctattaagagccagctgttatgaatgtgagatggtctatgcacaattatgttaccaatattgtatgctgaaaataatcagaagggaattttcatatgaaatctagatggttatatgaaaaaaggtaataatagactattaacagaataccagatatttaaactaatgtggacttgtaaataaaattaattcaaatttaagttcatttacataatcattttattaattatagataattaacatatgctcatttaaatgttcatttgaggttataacttaggcaacattgctttaaaaaaacaatttcaggagaatttcaggggtacagccaagttatattaacagatactggaaatgattaaaaagtagagaaaggacggggcgtggtggctcacgcctgtaatcccagcactttgggaggccgaggtgggcagatcacgaggtcaggagatcgagaccatcctggctaacatggtgaaaccccttctctactaaaaatacgaaaaattaaccgggcgtggcggcgggcgcctgtagtcccaggtactcgggaggctgaggcaggagaatggcgtgaacctgggaggcggagcttgcagtgagccgacatcgcgccactgcactccagcatgggcgacagagcaataatctgtctcaaaaaaaaaaaaaaaaaaagtagagaaagaagccaacaagagggaggtccttgtctggccatcacctgcacctgcctatgtctctcctatgatgtgggaatgtagatggctttttcaaggctatgtttatgaatatcgccattaaatatttttcctgtatatccgcattagtaaacgccctcccaacttctagtggaatcttaaacagagttaagtctatcacagtaaatgaaactcgaggtatggaaactcttccgtataattcactgatagtttcaaatatgactggctgactaatacaacaaagccccttcccaacctctcttccttgccaatctccactgcagaggctgtgaaatgtacacatcttccaagacttccttgcaagttaggatgatcatgtgatacattcctggccaatgggaggtaaacaggagtctgctaatggctgataaaggcagtgcttcctgatcaatgggactgacatggtcagagctaacacatcccttctcccttcttcttgctttgagtatggatgctatggctggaatcgagacagccattttatgagtgaaagatgctcacaatagatatcaaactggctctaatgtggttgatccgtaaaactgaaacatgtcattagcttccttcaaatttcttgatacatgaggaacttaaggcctgtttaaggcagtgctggtttgcttttctactgcagaggaagcacctatcagtagatctgttgacaagctatctattcatagtccatctactccactttataagcaaatttctgtgaatacttctaactctcacctacctcaccttagagatcacaatccaagctcaggctcctcaaacactctggtttaaaaacccagtgaacttgcttattctctgacccaatgacaaaggaaaatgaaagcattaaattcagaaccctagccaaaacaattagggtgaagaaaatggaaactttcaaattcactagtatccagcttaacattgttgcaatatcattaatagtacaagccatacaaatttatgtataagtaatccatttggactatacatttgaaattgtcaagtgagtatattggtgagtagaacctttacatgtgttcactgtaatgagaataaccttctcttaggtaacctactacacagaagtacagatcaatactcctaatgcagaaaccatttcaggaagtatcaaaagctatcaattgtcatctaattggaagattgtttttctaagtgaacagctataaaattctgactgttcaaatcactgtaatcattttatttgccctattctctagaggaaccttaaacaaaccctgcagtgattgctttgttatttcaaatcagcctagtaattttccagtgtattaaaagacattcagtgttgacactgctaggaaaaaaattgggcgtccgccggatggaactgttcattttcagtcaacataattactctgtattaacacatctgctatttaaacatatcacacttttttgctaataattaacttgatgggatcatacatctctattcgacttgaataaatatcagaatcatttttatattgttaaaatagtgccaagccaaatgaaatgattgggcttgagctatttattgtcagtaacataactcaattgcatgacctcctttaacaaagcaaaacaaatcaaaacaaaccagcctaactcctagatatatagcaatttatgtaatatcaggaaaaagaaaattaataaatataaaatattttttccaagaccttgaaggctgttttatgttatgaaatatgcaatcagtaccaaaggctgtcaaaatcatcttccttgtccacagttctgaccacattcttcctttctcaaacctccagggctgcctgtcatcttctgtatcaaatttaaattattctcactgcttcagggtcttctatctgcccttgtttatgacacctttcttttttttttttttttctttttgagacggagtcttgctctgttgcccaggctggagttcagtggcgtgatctcggctcactgcaagcttcacctcccggcttcatgccattctcctgcctcagcctcccgagtagctgggactacaggtgcccaccaccacgcccggctaattttttttttatttttagtagagacagggtttcaccgtgttagccaggatggtctcgatctcctgacctcgtgatccgcccgtctcggcctcccaaagtgctgggattacaggcatgagccatcgcgcccggccacgacacctttcttaatgtccctttccccattgttcactcacaagagtcctaatttgtaggactttcacactgcaatataattgattagaagaatgaatgatgcatcaaaagtcaaaaagcacagaattaggcaaattatattacccttattgttttttgctcctcccatgggaaaaaatcaagaactactaacagatatttttcctactatgtctttctgtagtaaccactcatcctcctacgattactttcaaatctactgcacattcctcttcatttcaaataatttgtcagatatactaagcaggattttgtcattttaataaaagtctagaataagaaatatacattattgtaacaatttctttcctgtgggaacatatgactcaaatatgccttttatttagggatcttctgtaaattgtaaagtaggtttgaggctttggagaaagatttaatatttgttgaaaatctaatatacttacattacttcattacttcatttaagaaatatccactaaatatcatctatagaaaaagacaagatactcaagactggtcctactttccactgcttaattatttatgctgattttcgttttgtgttgtgttgtattgtttctttgcttttagttttcaaaatgtattctccttttgcattgttgctgagatcaagaaattgtactctgcactactatcttcacctccagaacctgccagtgaaagcttattgagttagagggtaccatagacatcttcctctcccaggcttgcagagattcgccaggaggaaaaaaaaagtgagactcttcataattttttccttcctagcacttgtggttcatcatgttaccaagcatcagtgccaaaagccctgactgatttttatccactggggtaatcaaaatcagttaggattcaagtaaagggcaaagatctttagtctataccctatggctttccatagttatttttgttgtgtccaattcatctcctcatattctaccttgaatttgtctagtcagaaaccactgttagctaggttgataatgattgctgcattgctaaatacaagagataatgttagtccatctgttacttggcacttcaggaacatttgatccagttgaccactctcttctcctacaatttgttgcttctttagcttctagcacacaatttcctaattttctaccattttcactgatggctttccatatccctttgctggttctttgtacttttctccgcctctcaacacttgagtgtctcagggttcagctcatgtaccccattcttcttctatcattacttattatcttgatgaccttatccagtctcatagctttaaatacctttgatatgctagcaactcccaagttcacctctatgttatggacagctaaggttcatattcaactgttcttaaatatctaataggtccctaaaacttaacatgaccacagccaaactcttaaggattcatctgtatcacttccatttgatcttttcaatctcagttaatggcaaattccttctttcagtttgtttccacattgcttaggccacattttcttctttttctctcacaacccatatccaatttgtcacaaaagcatgtgttgtcactacgacaaaacttatcaacattggaacatttctcatcctttccagctctatcttatccaaaccccactctctctaatctgtatcattgaaataatcttccagctgacctgttcccagctcaagcctagtgaagtcagtcatcactattttctgtgcagagcctccactagcttctcatcattctcaaataaaagccaaatatcttgcatggcctgaaagtcctgacactcctatccctccctctgtgtgaatgtacttctcccagataagtgcatggcttgccccttcactccatactgctgtagaatatgttagtataatggttaattctatgtttcaacatatctaggcaatgtcttcacagcctagacattgctgtgaaggtatttttaaaatgtgattaatatttaaataagtagactttgaataaagcagataacatgggtcgactatacccaatcaattgaatgccttaagagcaatgacaaaggttttctgcagaaggaattctcctcaagactacaacctagaaaccttgcctgagtttgcggcctgatgctctaaagaatttggactcaagattgaacattaaccaggctcttgtaaccccaccacactgggagcctgaggtaagagaattgcttgagcccaggagttcgagaccagcctgggcaacatagtgagactccatctccacacatacacacaagattagctgggcatagtcatttgtgcctgaaggtccagccacttgggaggctgaggtgggaggtttgtttaagcctgagaggttgaagctgcagtgagtcattacatcactgcactcgagcctggaatcaaacagacacaataaaaaatgataaaggggatatcaccactgatcccacagaaatacaaactaccatcagagaatactataaacacctctatgcaaataaactagaaaatctagaagaaatggataaattcctcgacacatacaccctcccaagactaaaccaggaagaagttgaatctctgaatagaccaataacaggctctgaaattgaggcaataattaatagcttaccaaccaaaaaaagtccaggaccagatggattcacatccgaattctaccagaggtacaaggagacagtggtaccattccttctgaaactattccaatcaatagaaaaagagagaatcctccctaactcattttatgaggccagcatcatcctgctaccaaagcctggcagagatacaacaaaaaaagagaattttagaccaatatccctgatgaacattgatgcaaaaatcctcaataaaatactggcaaattgaatccagcagcacatcaaaaagcttatccaccatgatcaagtgggcttcatccctgggatgcaaggctggttcaacatacgcaaatcagtaaacataatccagcatataaacagaaccaatgacaaaaaccacatgattatctcaatagatgcagaaaaggcttttgacaaaattcaacagcacttcatgctaaaaactctcaataaattaggtattgatgggacgtatctcaaaataataagagctatttatgataaccccatagccaatatcatactgaatgggcaaaaactggaagcattccctttgaaaactggcacaagacagggatgccctctctcaccactcctattcaacacagtgttggaagttctggccagggcaatcaggtaggagaaggaaataaaggacattcaattaggaaaagaggaagtcaacttgtccctgtttgcagatgacatgattgtatacctagaaaaccccatcatctcagccccaaatctccttaagctgataagcaacttcagcagtctcaggatacaaaatcaatgtgcaaaaatcacaagcattcttatacaccaataacagacaaacagagagccaaatcatgagtgagctcccattcacaattgcttcaaagagaataaaatacctaggaatccaacttacaagggatgtgaaggacctcttcaaggagaactacaaaccactgctcagtgaaataaaagaggatacaaacaaatggaagaacattccatgctcatgggcaggaagaatcaatatcttgaaaatggccatactgcccaaggtaatttatagattcaatgccatccccatcaagctaccaatgactttctcacagaattggaaaaaactactttaaagttcatatggaaccaaaaaagagcctgcattgccaagttaatcgtaagccaaaacaacaaagctggaggcatcacgctacctgacttcaaactataatacaaggctacagtaaccaaaacagcatggtactggtaccaaaacagagatatagaccaacggaacagaacagagccctcagaaataatgccacttatctacaactatctgatctttgacaaacctgacaaaaacaagcaatggggaaaggattccctatttaacaaatggtgctgggaaaactggctagccatatggagaaagctgaaactggatcccttccttacaccttatacaaaaattaattcaagatggattaaagacttaaatgttagacctaaaaccataaaaaccctagaagaaaacctaggcaataccattcaggacataggcgtgggcaaagacttcatgtctaaaacaccaaagcaatggcaacaaaagccaaaattgacaaatgggatctaattaaactaaagagcttctgcacagcaaaagaaactaccatcagagtgaacaggcaacacacagaatgggagaaaatttttgcaatctactcatctgacaaagggctaatactcagaatctacaaagaactccaacaaatttacaagaaaaaaacaaacaaccccatcaaaaactgggcgaagaatatgaacagacacttctcaaaagaagacatttatgcagccaacagacacaggaaaaaatgctcatcatcactggtcatcagagaaatgcaaatcaaaaccacaatgagataccatctcacaccggttagaatggcgatcattaaaacgtcaggaaacaacaggtgctggagaggatgtggagaaacaggaacacttttatgctgttggtgggactgtaaactagttcaacaattgtggaagtcagtgtggcgattcctcagggatctagaactagaaataccatttgacccagccatcccattactgggtatatacccaaaggattataaatcatgctgctataaagactcttgcacacatatgtttattgcagcactattcacaatagcaaagacttggaaccaacccaaatgtccaaaaatgatagactggattaagaaaatgtggcacatatacaccatggaatactatgcagccataaaaaaggaatgagttcatgtcctttgtagggacatggatgaagctggaaaccatcattctcagcaaactatcgcaagcacaaaaaaccaaacaccgcatgttctcacttataggtgggaattgaacaatgagaacacttggacacaggaaggggaacatcacacactggggcctgttgtggggtggggggaggggggagggatagcattaggagatgtacctaatgttaatgggtgcagcacaccaacatggcacatgtatacatatgtaacaaacctgcacattgtgcacatgtaccttaaaacttaaagtataataaaaaaaaattattcccaaacataaaaaaaaacttatttctttcacttagcatattgcatttgaaagttatatatgttattgggtatattaatagttcattgctttttattgtcaagtaatacattctattgtatggctatatcagaatttctgcaatcactttagttgaaggacatctcgattattccagtttcaggtgattataaataaagctactataaacaggtgcatacagaaaaaaaaaaagaaaaagagactgaacatcaactgttatctgaatttctagcctgtcggcctgccctacaagttttatacttgccatagacatattagccaattctttaaaataaatctgtctctgactctctgtcatatatgcatctacatccatacttttatctttatctttaacagaaaggtagaaggagatttgataattgaaaaagtaggccatgtgaaggtggagcagaaagagacttgaagatgctggccatgaagatcggagtgatgaggccacaagaaatgccagcagccacccagaaactagaaaaggcatgaaaaaattctctcccaggcctccagaggaagtgcaacctgctgacaacttgatcttggcctagcagtgttgatttcaggcatctggactccagaattgtgagagaataaatttctgttgttttaagtcaccaagtatatgctaatttatcatagcagccacaggaaactaatacagtagtgacttgctcatctgcaggggatacattccaagccccctagtggatgcctgaaccacagatagtagcaaatcctatatatacaatgttttattcctatacatacacacctatgataaagtttaatttataatttaggtacagtaagatattaacaccaataattgataaagtagaacaatcataatacactgtaatcaaatttacatgaatatgatctcactctctgtctttctcaaaatatcttattatgttgtactcaccctttttttcttgtgatctgctgacctgcttgaactgagagctactaagtgattaacaggcaggtagctatacagcatggatacctttaacaaaggaatgactcacatcccaggcaggatggagtgggattgcacaagatttcattatgctactcagaatggcaagcaactttatacttacaaattggttatttttggaattttccatttaatattttggaccaggttgaccatgggtcactggaactgagaaaaatgaataaggggaactactgtaggtattttgatactgctttgggaagcaagatgaggctataacaaatgcctaaaaatgaggaagtagctttggaattgagaaactgttggaggctggaagcattttgagaagcatgaaagaaaaagtctagattacttataatagatttttggtagaaatataagtgctaaggattctgccagtaagggatgagaggaagtgaggagtacaatagagaaaggttctagcatcttagagaatatctgtatatcatcataaactgattgttggtagaaatatgaaagttaaaggcttttttaagggctcaaaagaaaatgagaaacatgttactggaaactggaggaaaggcaatccacgttttacagtgtcagataactgagcttaattgtgcccttcataattggaaagcggaacttataaactataaacttagatatttagctgagaatatttctaagcaaattgttgaatatatggcctgatttcttctcatggcttatagtaaaacgagagaagaaagaaataagttgaggaagaaactgttaagcaaaaagaaaccaatagcagatgattcaggaaattctcagcctacccaatatacaaaaaatgctaaaattatgagattcagtatcagaaaactgtgctctggacagaaggccaagggtatggagggacatcctttttacttctgctcaagagattagacatatagctgagggatccactcaactgtctcagcataagtcagacatagagaggcagttatccaggaaagatctggggagaacttcttgtttgatgatgtaaatcctcctgacatatataggaggtccatcaagtttttgagaatattataccatcagaaacattgccagcctggactgaaacggagagagacaaggcaaaaataaagaaggttattggacttccaaattctacaggcaggaaacaggctgaaatgactactcagctgcaaacattttctattcttcaagaaagaagaaaaatggcagtgggctttgtggtgtggcaggcctagcagtcaggggcccaggcccagaaggtgctggtgtcagcccaaagagcagaggtatgggctgaaaggacataaccttgagccacagagagttattcccagcccttacacactaatggagcttacttggttgaattttaaaattgcctgtgactcttctttaactcctattttttctcttttaaaataggaatgcctataaccattatcttatgcctataaccatgatcctatgctggtcccaccatttgtatgttggtaacatgttttctagtttcacagttccagagatagaaaagaattttgcctcaagatggatcatatttagagtctcacccatacctaatttcgatcattagataataagatttaggactttggagctgatgatattgtagtaatttgttatagcagccacagaaaactaatgcagtgagaagcacttttttaaaaattgcaacactcagtcatgctttctatatcctcccctcctttattttttccacatctccatatcacatatatttaaattactttaagaataagaaaacttatatatatgtatatatatatatatactactttttactctttttaaagttatttgtctccctcaccattgcaatataaactccataagtgcagcaatttttttatctttttgttttttcactgctgtatccctggtgctgtgaatagtggtactggtacataagaggtgctcacaaatgtttttcagtgattaaataaaaattttccttacgtatatcctcatagaatttgtccatccctccatctacattccatccatccatccacccaaccactttccatctctgtataaatccatctaccctcttacatgtctatttaatagcaaacattcttttactcattagccccaggatctgtgcaagaaattcaatggtaagtaagacttagaacaagcctacagagttatttcctcttcattgggaaaacagtagttgaacttgaactattaaaacaaaatgccataattatcactagcggggaaacaaaggatgccagggaagcaaattagaataatacctaatctagatgagaaagtcttcagaaaatactctctcattatacaaacctggagtatcatctttcttacaaccaacagataatgtaaatctatagagttctcaaacttacttctgactatactatagtaaaaaaataagtatttgtgaagaaatgagcatttgctttaaaattcatttcagcttaaataatattcatatttatgtaaagagagatgggtgaatctaactgtccacttaaatcttccttttaattcccaagaataaatgaactgtccaaagcacaatcaatattaaagacaatccagaatactttagactttccgtaggtaaatatcttgagataagaaggaaagtgtttgtctttcctggtgttcagcatttttgctgaccatgaaaaaagatgacgaagtaaagggtgggggcaagagaagggagaggaggaggaagaggaagaaagcaacagcagcattttaaaggcagacagcttgtagtatatttgaatttagacaatctcggttagcacgctaaattggaaacctgatagttcaatggatttagataagccacttcacacatcagtgcttcagtttatcagttacaaaatgagtttgacatttcccttgcctatctatggaagtattataagaaccaaatataagcacgtgcagatactttgaaaagtttaatttccttacaaatgtaagttatttttcacaaagacattttattgagattctatgatgtgctgatcaccatgtatagttatttgaaaatcacaaataatttgggatttgcaattatgagaattgagggcattaaactttagatattctgcttacagatataaggacaaatgtgtggttttaaacacagagcaaaaacgacataatagtgaatgtgcaataggataacaggtgtttcatacattgagaacaacaaaaaaattggggtaatggaaattcaatgtcctagtcacaggcagtgggggaattttcttagatctgtgataacagcaagtggttttgttaatgtgaagctagtttttgttctgtggttattgccattcctgagtaatgagcaacgagatctctttcccatctggcattttgtggctgagaatagcagcagcataaggtgaaatgtcagtggtaagacacagtggtttatgtcatttgtaaaatatgatcacagactcaaacatccatggtgatgtgatatcccagaaaatatcccaatgcaagtgaatccaactccatgggggcagtgaaaagagattaaagtcaaaaaatagttttgaattttggttccactaacttaattgcctgttttgctcttggcccttgatttttctcatttgtaaaatagaaatgaaaaaatccctatttttcaaagtcatttgaagaattaaaaatgtgaatgtcctttaagttgtaacatgctgtatagaagttagtggtaactgctgtttttgtagataaccaaaaaattgattttgtccataataacagatgaaagcttccttaatgaagttgcattacacagtcccaagctttaccaaacacgtcagtggtgttggtaacagttatcaaaactaccttaaggtggtgtctgtaattttcgctaaaggacatgtgagaaaatattttgaaaacgtctttactgctaacaacataccaaataggcttcaagtccattttcaagcccaaagtcaagttaggatttaaggaaaaggaaactagaagagaataattcttaggacatctgaacattcaagatgattggagattctcattcatttaaaagaaaagaatgttattccttacaaaaccttatttactgaaataagaatttcatactttgatagctaaatcaaataagggttctgtttcttcccccccaactccgccttccagaagctgggaaggataatttacctccctaactgcttgacttaacccacagggacgtaggcactgaggggatctgtgattatctacacaagatgataataagccagataatttcagaatttagaattttaaaagaaaataaaaaattctccctaatgataccactgcattgtaaattctacacatcactttccgtagacatcttctagcatacagctaagtgtcttatatcaaagaccctgccttcatggaggtgggagaaggaagttagaagctgccaagagaaaagaatcttggagagtaaagggtagaaatttctggaaaggtttgagtctttcctactgccattggcactgctcagtgggttgggggcttgggctctgtcatcacactgctttggttcctgtcctggctatgtttaccaactacatggcttcagatgacttaacctgaatggagataataacacctccctcatagggcagttttgacaaataactgaagaagtaaagcacttaaaacagcccttagcacaaaataagcacatggtaaatatcagttaccactattgtaactactaccatgacacccatggctaaaattatcatcaccattattagtagtactattatactattatttgtcctgcatgttaaagtgtttcttcaaagaagtcagagcatgggaagaaagccacattgtctgctatctctgaaaaaaaaaaaagagaaggaaaaaaaacagaaaaaaagaagtcctttttgaaaaagtccttcataatacttaataccatgcaagttttcagggtaaaggctgtatgccttaataaagggaatgcattcttttgttcttattttaattaatagtaataaacctgtttcattctgcatatatacttattcaagaagaggaatgtttttagtagatgagagtcttgtggcaacccatagtttaggcaccttttagccattattacattattttctaattccttatggccagtcattttagaactacaggctcaaagaaaaggtccccttgttttgcaagtgaagatttgtttcacaggaatgtgtgagtcagctgtctgatagagtgtgcaggtttgagggggaggtatgtgggggtgagatttaaagcatctaagatccctcccaatgttgacacttaattatctggaagaggataatgacttaaaattccagaaaagaatgattatgacaggaaaacataagtagtaacaatatattgaaccctttatatgaaagaggtagaaggtcttgtacctagtgaacataatctcattgaattcctccagcaatcttaaaatatgggttttatttacctcatattacaggtgaggaaactgaggcacaatttggcgatgtctctgcagagaactaaatgatcagcagaactgaaagccccatctaggcttattaaaatccaacaccctcactctttccaggatgtgaaacttcctggagcccttcttcatgccagtctcacccttggccctttgcctcagggagctcactcaagcctcatcacagagctagaagtgagctatgattatccacatgacacatgtgagggcactgagaccccaaagaatccccagaaagcagatctggcattcatgatcagcaacacaataaatgctgccttatagtgtttgattttctggtggcaagttatgtcttcttaaattgccagatgaacgcaatgcccatctcctttcagctagcacattttctctttgccagggaagcagtgctgcgtgatggctgagcacctaagctctaaagtcagactgcctgcctttaaagcactgtcctgtcactcaccagctggtgaacgtgtgaagtttcatccatttcttcatcttgaaacaatgacctctgaggcttgttgggagcatcaactgagtcaagtcatgtgaaagcattgggataatgcatggagcctaatgaacactcaaaaacattaactactgttgttgttacagttggcccagctagaatacactttgtcaatatggtcctcagaccattgcctcagaatctcacagggtaaggcacctctatcattaagctaaaaatcccattttaattcaacaattgaagacgtgtcccgagattttacttttctcacaatctcccaacagtgccaacgctgctgaacgaggtgctttaaatagcaaggaaccagggaactttattgactacagatttagtggaccctattccagacctagtaaatcagaaactctggggaggaaacccaggggaataaatgtttaactcactctctaagagattctaaggcatgtaaaagcttgagaaggccgtgagagaggcttcagttggttctaacattatttgacagtgcaattcactggagacacagtctgatcgaattcctgattcatcatcttgactccagggtaaaatgcttctgatatgctaagaaaccctcatccttttctgtaacaaaggtaatgagttaattttccaaatagggtaagtagataatccttctcaatttaccaacataactcacccaatattaagaagcattagaaaaggcatccattttgccagtgcaactaagcagtagttttctagcacaaatattagaggcaataaagaattttattcaaggttgacagctttagcaaacagtttctgttttatattgatgctctcttattttccatgttttctcagcattctggatatagcaccactaaaaaaattcttttggttaaattctgaatagtttaagctttaaaatgcaacttattggaaagatacaggggtaggaatccaagaaatatttggacaatcctcgagtagggcagtgaccaggttagctcatagggtgaccaactgctttagtttactcaggaccatcctagtatcagcactgagagtaccaagttctggagaatccctcagtcccaggcaaacaaggccagctggtcccactagtgccaacctggcagtaggctttctatggatctcttaatatgagtcagattacattgctcttattctgtccttttccaaattccagattcctgacaaagagaattttgctggattagcttgggtcagatatctacacctggcccaatcagaagtaggcaaataacaaattgtgctgtcctcccttttcctcaagctgtccagggcccaacactgtgaaatagggaccaattcgtagagaagacaggatccaggcaaggaccctaaagggcatctattacagtctttcagaaagtgtctccaattactttataaactcacctttcctttgctttgctttcctgaatgcacccagggatctatgagctactaaaatcaaccatgcttcactaggtcacagcagagggcttggttgtgatagaaaacaactaaaacgtgactgacattcattgagcacttgatttatacaacagatatatagatgacagatagataaatagatagatatgtagttttatcagataaatccagtgatgtaggttctattgcactcattttacagataaagaaactgaaggtttttttttttttcagttatgaaggctaggaattgaaccaagattttctagccctcaaccaagtttctatctacaacacccttttttttctttttcctctctccctccctttctttctcatcctctctgttcctctccctatatatgtatagtcatattaatgtgatagtcttacagatattcatatatatatatatatatatatatatatatatatatatatatatatatggacttagatacaattgtgtatgcttaacagttaggattttccgtattaggctcagagagaattggctaagttgaacatttagtaagtggaaatctttgacactgcagattaaactcaaatattttaattctatatctagtcctccttccatcgtatttctccatcaaactttttaatgcctcattatctgttgcttaatacgaagagaagaaaacccaccccatttttatatctgcaataatggctgaagaatttcttctatgtcttctctgggcaaagcatttgctgagcacttgatatggtattaccttcaaagaaactctgccagttacagggacattaagtaatttccccaaatccatacagcaaaaataagggcagagcaagccatctgccctgaaattccttgccctttccagttcaccaaattgcatctttgaagtcggatcaagatttgcgtacatatcctaccagtctaagcacgtttgaatgatggcacattgtctcactatattgaggcaactcttccttgcttggctgttactcataattaggaatacagttacatctttcactttggtccaatttttatcatatcaatgtactacccacctatatattttcttaatttatatttctttaaatcaacttattttttatgtctggccctagtaattatatccataaagtccaagacgtagtgaacttatttcataatttataagatgaattacaataaatatgtaaacattttaaaatgcatgtcttaaggaaatgtttgaatcaacatctaagaaaaattggtttgcccagtaagtcgcgtatttgtggggtcagctagcctgatccagcctttacagctccatgtagatttgctcttcttgactattgctgggtggtccccactgttctcacatagccaaataagttattccattacaaaattataactaattttttacagaatgaattatagattagggtgctctgcatgaatttgcagattcccaaagatctcaagatgtgtcaagaactccaagggatctttcacttcgtatttcaccgccgggtcaccctgggctccaggctatcttgagctgttttcacatcttctctgatggaacattttaaatgaggcaaattctgaatctgaaaatctttggtggcctttgcacatatcctcttcagttgtggaaaaaaaacatatccattgtatctgacttttcctttttcactctccttccattttactgtctgcttcattgaggaaatctttcatttagtggagtctagatttcttcctttgctaccatcttcatttcccaccaaataaatcaggtctcagcttatgatcatttgtcatctgctgcttcttctccgggaccgcccctaacagcctagcagagctctgggctgtattccatgatctcttttaattccttgttggcggcttgctggccctttctctttaccttcctgccaggtttaatgccttttagcgtgccagctctgtttttcacaatttttccaaaatgaggtggaaaatcaaatctctagctcctaattctcagtgggcaatattttcagagaatccttcaacatcattcactctctcaattcctcatcttctgagcttctccatccataaaacaatcagaaatgtcttcctcttaataacatagctcttctggtattggggagtggtgggactagaaaagagtagaggtgtaagcaatgcaatatgagttcattcatgcaaataaaaatcacactccctggacagaatccctctttcccgcagatctatctcttctagagagtatggacagatggaagaagtgagggtatgcagagctggcgtatggcagtcccagaacagggtcactatcaaaaagcaaatgccaaccatgtgatatataggactgctgggaatgtagtccatcattgctctatggtaaaaaagaataccttctctaacatgacattctctgaaccacatatagacatacacacatacaaaaataatctctaatcatgaccatcagtttttgcctgactgtctcagcatcctgttagctacgttcctgccctccatcttattccctgtgaatccatcttttatactgatgacatggtaacacttttttttttatactttaagttttagggtacacgtgctcattgcgcaggttagttacatatgtatacatgtgccatgctggtgcgctgcacccactaactcgtcatctagcattaggtatatctcccaatgctatccctcccccctccccccaccctaccacagtccccagagtgtgatattccccttcctgtgtccatgtgatctcattgttcaattcccacctatgagtgagaatatgcggtgtttggttgtttgttcttgcgatagtttactgagaatgatgatttccaatttcatccatgtccctacaaaggacaggaactcatcatattttatggctgcatagtattccatggtgtatatgtgccacattttcttaatccagtctatcattgttggacatttgggttggttccaagtctttgctattgtgaataatgctgcaataaacatacgtgtgcatgtgtcttttatgatgtaaactgaaccatgtcaatgtcccaccgaatagctcccacctatgactgaaatcagtgagcacttcacaaagagttttggatggttggcaagaggtatagtaggaaaagtagtagtgtgcttaaatcacacagccatgatgacaggtctcacattaacttcctgatcgctaacctaaaaaagccctcaatgctgcctggctatctgactactttactttagacttttcattcccctattctcacagccaactgattcttgttgtttctcacctccaatttcttacacctgtcccatcctcattctcagcttaaaacttgctgtgaaaatagaagcaatcagaagagaacttcctctagcttctaccactagagattttcatgtacctgtatctaaactcatacacccctcttgtttctcttaatatggactaactgaacccttttctgggaaagacccattcttcacctgtgcacaagactacatcccctttcacctgctctaagctccagctctcctcttatttcccctacgttatcactgtttttaatcaatatataaaaacagcattatcttttaaccatcatcatcattatcatcatcaaaacctcacttttctcattttccctccagctactgtttcaaacttctcaaaagagtttctatggccactctcttcaattcctttactccaaattacttttgaacatgattcaatctggctttcacctttgtactcataaaaatggctctctttaaagtcatcaacaacttctcagtccagatcttacctaaccagtggcagcatttgataaggttgaaggatccctcctggaaacacgttctgaatttggtttccatgacattaaactgtattagttttcctatttcttcccttgtttttcttcctgtctcccttgctcttcctcctcaaccctataagctcttaatgaagcagtaccccagggactacatttagactttccagtttgtctgcactcacactctcactggttttacccagtctcatggctttatgattaacactgacagctcccaaaagtatagctcctcttaggacctctctcctgccctccagactcatacatccaattgcctgcttggcaactctgttgggtatctcaaacttgtcaggttcaaaacagagctcccgatatttcttactcccaaatatgctccttctttactctccccccatttcaggacaggtgaagtcttataattagtgaggtcaaaaatgttagtatcatgattgtcttttcttttctcatgcttcacatctgatctatgagccagttctgtcaggactaccttagtagttttcagcatattcagaatccaaccactttcaccatcaccattgcctctgtgctgctctgagccttgttcatctcaagcttaaattattgcaatatctttccaggtggtctccctggaaagtcacaaccttgtaatctcctctctacacaagggccacagtgatcctgtgcaaacgcaaattggatgatatcactcctctggtccaatcttctcatgtctttcagtctcagagtaaaagccacgatcttgcaaaaacctacaaggccttgcaaaatctgccccccgccccccatctcttgtgttttattttctttcctattgctctttcctccattcattctgttccagctctttgcacagttccaagcatcctgcggccttggggcattcacaaaattgcttgctctatcttatcattcccccaatcccttacccatcccatatattcatggtttttctctcacctttaaattttacccaaatgtcatcttctcagtgcaattttatttaattgcagctctccctgttggaccccttcttgctccacatttgcttgtctccattgcacttaccactgcctacttgactcttgtcttagctcagattgccataccgaaataccatagactgcatggcttaaacaacaggaatttatttctcatagttctggatgttgggaagatcatgatatggactgattcagttcacccttatgggctctattcctgacttacagtcagccttctttttgctacgttctaacatggcagagagagagaatgctctggcctctcttcctcttcttataaagatgttaatcccattatgggagtcccaacttcatgacctcatttaattacctaattaccatccaaagtccccacctccaagtaccattccattgcaaattagggcatttttactgcaaaatttctcagtaactttagagaatgtcatgtatgcatctcctgggggaggtctgggcagataaaattcccaatgtttcacacatacatttgaccactgggttgtcagggaatcttttgggatgtatcctttagacccctgctagtcatgatgtggtttgtggaccagtgcaggttcacaaattatttattgattgtctgcaataagagaaatacagaaacggagagtcaatatttagaaaacgctataacaaattgacaatgctgccaagaatagtcatatggtttggctctgtgtctgcacccaaatctcacctcaaattgtaattctgacatgtcaaatgaggggcctgctgggaggtgaatgaatcatggaggtggtctctaatggtttagcaccattgccctagtgctgtgtcctgagttctcatgagatctggctgtttaaaagtgttcagcattccctgtgtctcgctctctctccactgctccaccatgggaagatgtgccttgcttctccttcaccttctgccatgattgtaagtttcctgaggcctccccagccatgcaaactgtgagtcaattaaacccattttcttcttaaattacccagtctcgggtagttctttaaagcagtgcgaaaatggactaatacaaatatgaacagtagcttgtgaagtttttttttttcacacttcatttttctagtaattcatctttattgtgttttacaaaagtatcagttcatggcagatttaaagtaataagaagaaaaatctttcacttactgcagataatttgggaagcacctcctccaggcagattttaggaaatattggttaaattccaaaggtagaaaaaaatctcttgtaagtccagtctctagactttttcctaacattcccagctgcaccttgtatgccaactgagtcaacttgctcctctaagccctacgtgtgtccgggctgttcatctgcttgccatgtctttcctgcctcacatgcctgatgcacattttatccttcagaatttggttaagaggttaatggtgctagaaagagtccccagattcctctccataaacttgatgacctcactttacctccacgactttctggtaatcttatcctcaaatcagtgctccactgttgtttttgtttagattttatttttaattgacacaaaataattgttcatatttataaagtacaatgtttcaatatatgtatataatgcatgatgatcaaattagagtaattagaatatctatcacctcaatcacttatcatttctttgtggtaagaccattcaaaatcctttattctagctgttttgaaataaacaatacattcttattaactataatcaccctactgtgcaatagaacaccagatcttattccttctaagtaaccgtaactttctccccatgaaccattttctacccattccccttcccccatgtatttgtgtgttttcaccctgctgataaagatatacccaagactgggaaatttacaaaagaaaaaggtttaattggacttacagttcctcattgctggggaagcctcacaatcactgcggaaggcaagggggagcaagtcacgtcttacgtggatggcggcaggcaaagagcttctgcaggaaaactccctcttataataaccatcagatctcatgagacttactcactatcaccagagaagaatgggaaagacctgcccccatgattcaattacctcccacctggtccctcccacaacacacgggaattcaagataagattttggtgggtacacagccaaaccatatcatcaactactcttcccagcccatggtagccactattcaattctctacatcagtgagatcaacgactttagattctgcatatgagtgagattatgcagtatttgtctttctgtgttaggtttatttcagttaacataatgtcttccaggttcatttatattgtcacaaatgatataggattttattctttatggctaaatagtattccattgtgtgtgtgtgtgtgtgtgtgtgtgtgtgtgtgtgtgtgtatgtgtgtctatgtgtgtttgtataccatatatatgccacattttatttattcatttatttattcattttatttatccatttatttattcattttatttatccataaatgttaatgaacatttaggttgattccataacttgactattgtgaatagtgttgcaacaaacatgagagtgagacatctccttgacatactgatttcatttcctttggatatatatccagcagtgggattgctggatcataaggtagtcccagttttaattttttgagaaatctccatattgtttttcataatggctaaactaatttacattctcaccaacagtatttaagggtacccttttctccacatccttcccaacacttgttatcttttgtatttttgatagaagtcattctaactggagtaaggtaatacctcattgtgttttgatttgcatttccatgatgattagtgatgttaaatatttttttcatatacctctttgtcatttgaatgtctttttttgagaaatgtctagtcaggtctttcgcctatttttaaaccagattatttgtgtttttgtgattgagttgtttgagttctcttttctctccaacttcatacctcatccctgggcaaccattaatctagtttctgtctctatagatttctgtattctggacattcatataaatggaatcataaaagatgtggtcttttgtgtttggtttctttcacttagtataatatttttcaaggttcaacaatgttgtagcatgtattcgtactttattcctttttattgccagtgtttgctagtattttattgagaaattttgtgtctacatttataagagatactgctctctagttttcttttcttgtgctgtttttacctggttttggcataaggataatgctagctcctagaatgggtttggaaatattcctttgtcttctcttttttgaaagagtttgtaaagaattattactaattcttctttaaatgtttaatcgaattcaccagcaaagccatctggaattgggctttaagttgtgggaaatgttttcgtttgaaattaaatcattttacttgtaataagtttattcagattttctatttcactttgaatcaatggtggttgtttctggttgtctttctagaaatttgtcatgtcatctaagctacctaatttgttggcacacaaatgttcacagcattcctatatgatccttttttatttctgtaaggttggtagtgatgtctccactcccatttttgattttatcaacttataccttctttcctttcttcttcagtctagctaaaattttgtcaattttaatttttttcttaaagaaccaattagaattgattgattttttgtttttctatttcctattttatttatttctgttctaatatttactattttcttccttctgattgttttgcatttagtttgctcttctttttatagttttttaagttgtcaggttagattattgacttgagatgttattatatagacatttgtagttataaatttctctgtaagtactgtgtaagctacattctataatttttcgtatgttttatcttcattttcatttctctcatagcattttctaatctttctggcatttttcagaccattgattactcaagagtgtgttgcttaatttccacataattgtgaatttctaaatttccttctgttactgatttctcatttcattccactgtggttggagaccatactttgtataattttttaaaaatttattcagacttgttttatgccctagcatataatctatcctggggaatgttccatatgtacttgaaaagagtatatattctgctgtttttttctatcacgcctagttggtgtctatcacatctatttggtgtatactgttgttcaaagaaatagaggacttgagcaacgctatacaccagatagacctgacagacatttacacaatgttccataccaaagcagcagaaatacttgactagttgttcagaatttatttttaattttaataaatatatttcaatgcatccatctcacttactcatttctcataaaagtaatatgagtaacacccctctacgaccatggaaaaagtggctatttttgattcctctgattcaatagatcactgtagaacatgaagtcaccaaatattcttgtgtaagagctctctgaaaattaatcttgacaggattgttgggggattactggcacaggtgtagactgccaggctgtctctcctgctttgcacatagccttttttgagtataaatagaagaagaacattactgctttctgctatttcaggaaagaacacacccatttatttagtcattcataagcactgagttgaatgcctactgtaagacaagccctaagagtacttatagtaaacatacacttgattctactatgacataaaatccagaatctgatggccaatcctactgacagcagctaagagtaagaacttgacatgctcagcaggtacataagatatactttccagatcaatgctggattatgaatgctttctgtccacaggattctctacatgctcctttccttacctccatcaatttctgatgtgggcaagaaggattgttgtacccaataactgagtctacaaactcaactctcttcattatgtctagggcaatgcccagtgtcctaagaccaccagttgcaacctcctacaataaccccattacattggctaattttgttgatatatctgaatacatacatatctgactataaaacatgactctgaaacttactagatattggacattgacttgttcgcctaacttctccaagctttctcagtcttttaatttggagaccaggcatgaaaaatatttatttcacagaattgtagtgagggttaaatatttaagataaggtacctgacacatagtgggcactctccaagagtggtagcttaaaacatgcaaataacaattcttggctccttattctgtgctctggacttacatgtgagttctcagctaggagttaaggctcattctgaaactaagctagtgacctggtccttcatgtgctccagcacctgcaaacaacgtgtatactcttccctggagcaagaacaccaaagaagtgaggtggagtgcttccttcttttagtcctctagttgtcagctggaatactgactgctatgaatgaactgaccacctggtactatgcttctggtggtcattatcatccagcccttacaacacacaagttcactatgctctacccactacccctagagatcaggatcattgtcctcaggcctgtcctgcctagttcttttgcttcctccttttcccatttgttcagggtattaaaatcccaaaaccctgcaagactctgcccagtcaaattatgaacactaaacaccgaactccaaagtctaacccacaatgtttatagtatgctgtggatacatctgacttatattaagacacttcagggaacttatgtgactcaacactcaatgctgaccaagatggccccctaatctaggccagatggcaaactgatcattaacttcattctgatggacttgttttccccaaaatgagctgttataattaatcctctgttatctggcattttatcaacaaatatcattcattaactaacattttccctgccagttcaactacaattaattatcacaatgataagctgtggcactaagggattctgaaatcatctcaggattcagagagtgacagaaagagaataagagagagaatgagagacagcaagagagagaggtcaaatcatgctcagtagaattttaatattaagggtataaagcattgcttctgcagtgtcctggaaaccccatcccatttatacaaatgccccagataacgtctcctaatggggctgtcatgtaatatatagaaaatcaacatactttagagttggctgaatttcttcagcaagcatggcctcatccccaccctacaatcgcagtaccccatccctggcataggtcaagtccatagaggtgaagcaaatctatctaatcctggcagagacaatatatcactcagtatcattgtatttaccatcctacactttaaaagaaaacaaactccttaccctgatcctacagcttttcagaatgattaaaaatcttttctgaaatatgtcatggccagaatctcaatgaaaaaaatgtgacaaaccaaaaccaaaccaaaccaaaccaaaacaaacacacacacacacacacacacacacacacacacacacacacacaaaacagaacataataaaacaaactggatacaacaacttttcttctgggttttggaattaatttttacttcttaaggattgttaacttcagcaatgggatgagtgccccatttggtacatggtaggcattgaaggcattttggtttgtttgtataacaagagttaataaaaaaatgtaggtttcctgcagccaacttccaaaaatatataataaatatttgaatgatacgtgtttccaagttggaagcggtctgtttttctggatttgagtctgttgtaggagctacacgcagcctgcctcattgctcacaacactacaccacaactgtgtggttgacgctggaactgtggcaatggagccacttgagggctacggggttaggcagagtaaatgaaccggcctcaaaaccaaggccgtctccctctgcaaaaagataaaaggaaggaagcaacaaaaggtggatatcttcataaaaacattctcagatagagcatctcatgtaattcacagcagacacgccaagacatgataagattcttgttattgggattttaatgatcccagagtcctgctgcgtcagtgtcctgtcatatcagctctgtggcttttggaaaaaaagagcatggtgttttctgaaagtcggaaggccattgtgactcatttctgagactctctcccacttaggtatatcaaataggtatgctgctttgatcaggttaaatttttaaagcccaagggcactgaggatgtggccatgttaataatgcagagccgcaaaaactttaggaaatatcctgttatcccatcagtgtgggcagcaagccttgggtagcaccagcaaaccctgagagatcctgccagatggaaagctggcactgatgggaacaaattctgccccagaggatcttctttgagagtaacccttagggcaaatggatcactctgcaaaaagcttactggagaaatataggggtaggtaatcacatgtttgatttcttgcaatccaggttccaagctcaagaaaacctattcccagatataaagtcaaaaagagagaataaagccaaaaactaggatgaaggagaatgatcacatagttactaaaagaattaaaatgtacaaggaaagacaataaacatcagaaaggaagaagaagagaataaatgtgtgaaaaagacctgagatcaggcccttgattagcagggagaaaagaatctgaacaaggcaagtaagggaacccctactgcaaggtactgcctcggtaccggagcacagcaggcaagaaagactgctcgcaatctccaaagaaaacatttcagaacaagagaaaatgaggtaagttgtgctttcatcgcttgcattacgcggcggacccaagttcgcttgaatggtaaacgagcgatgatttgtaataaacggtttaggctgtggggttggctcttcagtcctaacacagtcccactctctggggacgagtcatactagtggccacatgccttataggatttggtgtcacccagagaaagagaaaaaaatctaagacaagcatctctcattgtcactattaataggaacttagagactgatttttggatcacttgctcttaaactgtattcagatgttgtgaaactggctggctgacaaatctaatcaaattaactccaccttaaagcaaaaccctgtttcgcttttttgctagcgcacttttttaattattcaagcaaaacagctttcttattcaatttgaaatctgtatttgtgcacaagtttgtctcacattgctcaacatcatctattaactgtttacacacagcagtgattctccaaaactatttttgatcttctaaacacatatttaaaacacatacaaacagaagaaaacactctgaaataaaatacactttattctattatattattatatacactattttatttatttatgttattattatttttctttgagacagggtctcactctgtctcccaggctgggatgaagtggtgcaatcgtgtctcactatagccttaacctcctaggctcaagtgctcctcccatctcagcctcccaagtagctgggactacaagcacgtgccaccatgcctggctattttcttcccccaccatattacccaggtttgtctcaaactcctgggctccagtgatctgccagccttggcctcccaacatgttaggattataggtatgagccaccgcacctggccaatatacattatttttatcataaccaatcctccctttttaaaatttcctctgagacttcttcccaagttaatcatcaattactacagagtaaattttttcaaggggaaaaaagtccttctatttcaaatatactatgaaataatatcttcatcttaaaaacatgattacaagcatcttttaaaatattatcctttcctttcaatgaaaacgttttgtacaaataacttgggaaacaaaaatgcttttcctggtcaagtagggatttttttcagacagctcctctgctgccctctaaagttcaagaaaaacataacagctctactttgcagacagcattttttttccactgaaataccaggattctctaaacttcaaagataattggactcattagtctctgctctcaatacagtgtggccaggcacgtctgctcaaagtgtacatgtgataataccgaaattaaaaaaaagcttaaagggcaggtgttgatggtatttttaatgccattgctactaaatgtgtccctatgattcatgtgttactacacaacataatcatgtaaatagccagaattttatgtttggaaaataatccataacttttgggatgttcataatttgtgttttgcgcttttctgttaactacgccacaattgtggccgaaatataataaaaatgaggacagtaggcataatattgggactgtctgctaagaaataatacataaagctatgactcagaaagtgatgtatgttgcttcctgaactcacccactttaatgacagagccagggccttgacatcgggacagattattagaacgtgaaggttggtactgccggttcagagaaaggaggcaagagattagcaaaaagcaggctgtataatgactagtctggagtggagaagggagggagattagctcctttctgttctttatgttagggacaaggcagagagcaaaagaagaaaagaggaaaggagaaagggaagaaaggaaagagagaagcaagaggcagggaagaaaatgcaatatagaatattcattgagcctcttctttgaactaagtactttaacttgttcacaataatcttgtaacatgctactctctgttctacagatgagaaaattgaacttcaggaaaaatagataatgtggtttagttgtacaggttgtgtacagtgcagccaagtgcagaaaggaaaggcaaatgcactagacattgcttcctctgcacttctctatgctttaaccaaataaccttctgagttccagctagggagctggcaggagagatgaagaagcatatgaaaaaataaagagaggcacacagtcacagacaagaaggaggattaagggtaattacaaccccaaagagcttgtggtgactcactaaaaagccacagggagaagcagttagttacaagagaattcttggccaaacgcccaattcaagggccagctgttgataatttaacaaaaaaaaaaaagtcctctttgaaaacctaaaatcattagagaagtacttttcacttcagctctgcatcagcagttagtttggatcagcagccaggatggggcattaatgctttaggtagagggggtctcaaaatatggctcttggatcagcagcatcagcatcttctagggattggtataaacataaattctcaatgctctccctacctccaggctcacaaaataggcatatctaggggtggggtctagaaatctctgttttaacaaggcttgcaggagattgtggtgcatgcttaaatttgagaactaggtttgtataagtcctttaatttgtttggcaagtactctctgtggcttttactatcaaggcaagtttgagaagttctgtttttaggaattgaggaaaaacttttgccctaggcccactgaaaaatgcttccttcctctggagaaagcgatagtaattcagattctcttccctcatttcagctgtggattcattgaaattagggcagtagagtactaattcccagagtcctaataaatttgacttcctacttctgggtggaggaacagaattgggagagttgcagaagctagggaattaagagaataataattagcaaattttatcggaatctttatctctgtatttcagttctagaaattgagtattttatatattttatcatgattatataaatggagctaaatgagtttcctgaaatttacattttatgcacagaaaacaggctctgccaatatttatatgttctagttcctatagattgtagagaaaggggaatgagacagtaaacaatgggcttaatttccttttcaacagggcttcataattcagtatcaatcttgtggaacagatattcccatttcacaggtgaggaaactgagtcttctctggctacctactcagctatgggcaagattcaaaaagaattcctccatccctggattttaaattcaaatgagaggacctatggtatccctttggggtcagaaaatacatcatactttattttatgtccctaataatatctggtaaaacatctgacaaaccatttaatcgatttctaaataaaaatattcttctttctttttattggttgcatttggagaaagaaaacaaatacttcatgaactgaaatgtatctgcatcttttcttggcatgaattcactttctactttgtatcatcacaaagatgacaatgtcccatgtggcagaggtgccttgaagttaaccagaaattcctgaagctttttccataatgtagagttgttgctgggaatggctgcccagtcagggactacattcctaggcatctttcctagggatctataacaaattcttgttaatggaatgagagtagacacaatgtgtgtcacatttagggtggagcagataagaagcaagcattacctccatttcccaatccactgagtgcagaggaccccgagatcgtaggagatggtagagcaaatagggggatagaacctggaatcctgaaccatgagagagaggaaagtctccagtccccccagagtgctcacaacatgagtgagaaaaccaatttcattatgttaattggctgaaatgtgtgtgtgggggggttaatattactacaactatcattaccttaatcagtgcatttcatttcttctcttagattatcatgttttatgttagatgatgaggtttttgagggtagtttccatgtttggaaaaatatggattatatagctgaatcaggagctgggtttttcactcatgagttttgaggaaactggtgttttttcttccccttggcttctcttcaaggagatactgattacaataagttgactatttgaaacgcagttcaggttatcggtaaaatctaggctatgcagtcagctagatctgtattcaatccttggtttttctctaattaaatgtatgaacatactcaaactgcccagtttttctcctcttctgcaaaatgagtgttaaaaatccctatattctaagattattatgaagatgagagttaatatttataaatgcctagtatagtgcctggctcatagctagcattagccactggtggtagacttctaaaaatatgtcctctacttttcaggagagaaatatactatgtcaaagccatcaggtttggtcatgtgatttaacttggtcaacaacgtgtaagcagaaaagatgtgtcacttgcaagttgaacctgatctctttctttctgacatgatgattggcaacgtttcgttagaaattgctccattatactggatatcgaaatgaagatgacttggagcaaagccacaattaccctacaatagggcaaatgttacttttgctgctgtaagacattaggatttggggaccatttgttactgcagcataacccaacttttctgaaaaatacataaaatatatatttctcagtcagggaatacggggaaatcctttaaactgtcaaattctctatcgggaactggggcatctagccctttccctgtccctcccaccttgcctcctaagaatgactaataataaaaacagcataggctttgtccttgctccccttcctggagaggctgtaaaactctacaaaatacagaaaatgaaatattttctgatggtaaaagagtttttttaaaaaatctgaagacagaatcagatctccatgctgtcctttgggagttcagattttagaaaaagaaattggagctttacatacatttaacatacatcatttaattagagtatatatcttcagtgagcacaagaaaactttagataagagtttcatactttgtagtgaagcaaagttagtattggagaagtcttgtggggagcaacacagaagactgagaattcttttttttttttttttaagacagagtcttactctgttgcctgggctgaagtgcagtggcgcagtcgtggcttactggaacttatgactcctgggttcaagcgattctcctgcctcagcctccccaagagctgagactacagacaggtgccactatgcctggctaatttttgtatttttagtagggatcaggttccaccatgttggccaggctgtcctcaaactcctgacctcagatgattcacccgcctcagcctcccaaagtgctgacattacaggcgtgagccaccactcccggcccaggcaacttaacagagctgaattcttaacagggctgagaatttttaacagggctgtggagtaacagaacttgatggaaaattggcatctgtgtagaatgattctaaagctttcagacaaatggcagaatcctagggtaaaaatatcacctttattttctttcatgaactctatcagtggaatatatttagctgaatttctacttaagagcaggcaagacgaaaaaaatgaaggccactgagaattgtgtcaattactctaacttttctgttattattattattgaaactgccacagtgcacctagcaatttgctgctctatggtcctattaatccagagtctgcagatgaaaaaagcaatgtttttatgctgactttactataatcacagtgaaacaaaaaacgatcaattcattgaactccaaatatgcctcaggttatgatcttactttatcggacattctttgtaacactgaagagatatttcaaaactataaattgtgaaagtctccctactctcccttccacagtggctaagacatcttaaaaagaaagcctttccccaaagcattatctatagtgatcatacctttctgcagaagctgtcccaggtcaggtaaggaaaaaggaaggggcagaacagaaaggagggagagacttcacatgaggaggaaacaagcacattaaaaataattaaaatcggccaggcgcggtggctcacgcctgtaatcccagcgctttgggatgccgaggtgggctgatcacaaggtcagcagtttgagaccagcctggccaacatggtgaaacccagtctctactaaaaataataaaaaaaaaattagccaggcatggtagcaggcgcctgtaatatcagctacttaggaggctgaggcaggacaatcgcttgaacctgggaggcggaggttgcagtgagccgagactgcaccactgcactccagcctggacaaaagaatgagactccatctcgaaaaacaaaaaaaaaagacgttaataaaataaattaattaattaaaataaaaataattataatcaatgctttgttctatgttgcctaccttatattctttacagtttttgttcatactctctcctaacatatttttattaggagtttaacaggccaatatattctttctaaaatactgttaaaagacacacaggagaatatatatatctctacttttatgtaaatcagctttaccattttctaagtgtttacacattagagttgcactttactcccaaaggtacactgagttgtatccagattgatgctaattatcatcttacagatgaaactggggcttagagaagatgtgacagaagtgaaagcggagcccagaccaccgtaccacagctcattccacatggaaatgcctttacctacctatgaactgatactcagagcctggcaacaactttcaaccctccactcaccgacttttccaaataaaagcaagttacgggtcaaaatgttgtcatttgacattaaccattatttaaccaatgtccctataatcaagagacacttagagcatatatttaatgttgatcacccttggcacactgttcaaagaccagttcaggatgatgaaaatcaagttctcattttcaggccttacaaaactatactctggaacagtcctcgaaatgcaaatttggctatatcgcagctacagagatgaaagctttgtgaaactctgatattctagttaaagactattcatatccatttctagagtgacttctgattttgacatataaaaatatgttcatatttttcacccattctggatgatgcaaaatctagctggtataaccatgttatttaatttttaatttccgcaaacctcactttaaaatgcataaaccattctatcatgaagagcacctttttttccaatgcgctgttattaaattcttattcctgcagtgccttctcacagactagttttctacaaaagaaaaaaataaactcattgcttttcatatgaagacccagggttctgccttctagattaattacatttgattcaaaggtggctctctgtaagtaaatatctctagctcagaagcaaaaggaagggttcacttcaggtgtttttatcttcgctcaagagtcaaaataccttctgcattttatataggtaaagctagaagaaaagtaatctatacttatacctatacttacctgtctatctatctatctattgagtttttcattatgctgctgaaactagcataagaaaatttgctatctctgctatgaattaaatgttgtccctcgaatatcatatgttgaagccgtaacctccaatgtgactaaatgtggagttagggcttttaggagacaagtaagtttaaattaggttataaagatggggccataatctcatagaactttggcctcataagaagaggaagatgtttctcccctaaggccccatgtgaggatttagtgaaaaggtggctgtctgcaagcaggatgagccctcaccagttggccagcaccttgatcttggacttacaccgtccagaactgtgagaatataaatttctgttatttgagccacctagcctgtggtatttctttacggcaacccaataaatccctattttaaatattaagactccaaatctcaaagacaagttaatatgagtctatgtgctaaacctagaaaacctcaaatctgagttgttaaccagacgctgtgatattcatgtttctttttgttaggcttcagcatcttcctttgggggccaaaataattgtgtgtgtcccttttcttaagtgaaatctgtccctaaaatgtagagcactgtcttctttgtgctccagggttttcttccttttctccttggctccgtccttgcttacctcctttaacaaatccaggcaggactctgtcctgggcactgtcctaggtgctgaagatgcaacagtgacccaaatatggtccctgaccttaaggagtgtcctaagagactgcttgttaccagcggtttctcgcttcaagaaggtttcctgaataaattttaaaaatcaatgtgtgttgttaaaagctcagtgttacagttctgatccatgggttgagttataatgaattagagttccacaatttatgttgaccatattcccaaagccaattattcttcagtttttctattcaggttttttcttttgcaaacaaccatcttggctaaactttatgcagctccctagggcaactttgcattgccaaggtatttctcaggattgtgcctgacagacaccgaagcttagtgtctgaagcaaacttaatgagctcattttatagtctctcctctaggtcttgataaaaatattaaacccaaggaccaagactgaatacctttgaatatcactgtcttttctggattctgaagttaaaaatagccagtttctcagtagaacaccctagtcaacagcatatcaattaatctgtgtattatgggggccacaactccacagcttactgataagcgtatcatgggggcaaaatcagtagccttgccatggacaaaggtgaatatatatataactaactttccttgactctccaaactttttcatttaagagagcaataaatgaagatgtgctacttgaaaaatcattatgctagttctcaccaggctccctcaaaatatttatgaatgggtgttataattaatttcttatgagtgcaccatgtacagaaggtgcctaattctctgcaaaagcaagtcccattggggacttattctcccagctccaagccagtctgaagcattccccaagtgtcagaataacagtagggtattttagccaaaggaacacaagcctggtggtattttcttgctgatttattataactttcattcaccttttattctcttatttttctcttattgaaacgttgttataaaacaaacccatgaacaaaaatctatcttcaatgtatctagcctgttagtgtcaacctctcaacatatcctcctacccttcaacaaatattctgttcttatttattggaataacctttgttcttctttttgtatattgcattttattttattttttaaaaaatctttacttctatttgatatgttttggacttttcctttcttaatctggttaatttcccaatgttgaaccatttcaaattaacactgaaagatacagaaccctaggctctttttactatttatttacatatttatttatttatttatgtgttatttcttaggtagcatttgtctcaatggagatttcatgtccccctttaacctaggacttgggccttttgaaatctaaaaattttccttagtgccttctaaagtcataatactacacattctatatcatgcaaaacccacaagtatctacaaggcagtaaggttctttttaatggggtgggggaaatagcaaacaaaacaaaactgcagcaatcaaatgtttagcattaagatgttttccaaattgttgaagaagtgctgaagaaaacgttttggcgctccccagatggcagccattctgactccaaatgttaccgttattttggccctcataggaagtactttccccgtaagaccttgattcagtgattgaccttggttttgataatgtctcattcccttttagattaggaaagtccaagagaaagcaagacggggaatgcactaatgataagcagtataaatttcggaataggtttctcatcttttctagtgtgattatagggtttctagattcaatctggatcccttatacagttctgatggagagcattttactagtatgttctttacaatttgatcatctggatggcaatatcatatacagaaaagagaattggatttcagagctaggtaacttgggttaaaattccaacattttcacttactttgctgttttctaattttaaaatgaagggtagacagtccttttattacttcatcatttccacaaatacatacagactataacatgccaatcacttttttcaggttcagtaggtgaactttaaggtctcttattatttctctgtataaactgttcagctagacctctgggcttatatgtaagcttccgtgattcaaagcaaaccaaaatgtgggccagcccagtatctgcagggcataagtctgccagaagacacctactatcaccaactccttgtactttagattgtctagtctcatcctgctgctgctcaaaaagaacaaaacataaagcaaaatggaaaatattttaaaataaggtataaaatgtaataaataatgaggaaagctaaaaacaatttatttagcactggccatttatttgcataactctgtgggaaagtgaataagtgatgtagtttttattctctaatagcaaagctcacatggaatgagatatgcatgctaaaggagtgtacacggcatgattaaggctataaagctgtatggtttaaggagagaggaccacatgaacaaagggtggcttcaagaagaaagatagtgcttaggccagtttacaagtactttataagcttgctctttacaacatgcacatacacacacatacaggtaatctcaacatcattgtcatacaaaacaaaaatcaggtaaaataaaaaagcattaaatgggtggcaattatttcacagtgaaacatagtttcacacgtattcttaggaaaaaaaacattgaaaataaaccaaatcttcaaattaatagcagagaaaatatgcacaaaataaataaaatttttaaggatagatacaaactagtaaaatatacaataaaactcagaaaagttcaacaatttaaaaagccagttatttgaaattatcaataacaaaaatgaatagttttaggcacgagaatcatttaagaagtgagaatattaggaatgagaaaccaagataaataatattaggaatatgattgtatgttaaaacttagaaagacacaaaagagattttattatttttataataatatataaatttaacagtttaaatttgaaagcagatgaatttcataggaaaatttaaattaatcacattgactaagaagtttagaaaacctacataaatactgtataagaaattttaaaactggtcataaattcataacctattgcatcctaaaaagtcaaataaaattgttttatgataaaatgaaaccaaatttccaaaaactagctattccttacattattgaacaaacagaaagatgaacagattcccaattcatgtaattgtacaaactaatcctaactttgatactataaaacaaacaaataaaacagacaagactagttagaacaacaataacaaagtgaaaacacgaatcttttgtcaatagacaaacagaacaaattatactgggcttataaggaatctccttaacttgataaagagtaattaagagaaccttatcaaaacatcatactttataatgatgattcatgagaagcagtcagtttcactaatatgacaagaatactcacttgcatcaagcaaagcaaacataaaatttagaaacaatgagacagttgaataaagtggtaaggcacaaaataatcattgagaatctataactttgtatacctcagcaatagccatacagaaaatataccaaatattcagtttataataatggcaaaatctataaaacacatagaatatgtctagttaaaattattaaagactcatatgtagaaactgtaaaacataaatggagaacataaaagaaaacctaaataaatgaaaatacataaatattcctggtgcaggatattcaatattgtagagatgtgacttagttcttcatccaaaaaatttataaatatttaacagtgccaaacaaaatcccaaaggatgttcttttattgcacacagcatggccacttaaaacagggtgatagaataaaggcaggagaaaagcaaaagaaattaaacagaaatatgaaaggagaccagtactgccagatatcaaaaccatagttaggcactgatataggtgtagataattcaatcactggaacaggctagagagttcctaaataacacaacggttatctggaaagttgaaattagtataggaagtagaaactactcaataagtgtcccaagaaaaactggctattcaaatgaaatttaaaaacaaatcctgcagtgagttcaagggttttgggggactaaccaaggaaaaagatatgaccacaaggtagtaatagaacacaataaggtctatttgagcagtgctttgacaggtttacaggaaaaggtgagtccctcacaacatgagaactttcagaggcaatgctgcaggaatcactgtccaaaacagaaaggaaggaaaggggacgcctggagaagacccttccaggaccagagagggggcttaactaaatacatgaaggtggggacgctctgggtcagagaattctgaagggtcatagtggcttgggatctctcatagccctggagtttatcttatccatgtctaacagatgtttggtgcagtttcgtgtgatatgcaaaacaagcagctctaaatggctaaaaatgtgcttaatggggttatgtttaaaacaattgaatgtgttaaaaatttgagcttggcactggtgggcttctggactaatggattccagcctactgcgaagaagggaaaaacacacggcaggtccactatacggggccacttgtggctcattgaaataacaaagccttacctcacttttctttgcatgcctatctgcttatgcacacatctcagatgtattagaggtaaacatgaaaaaataatgtgagaaatgtaggaaattacatttataatattagggtgataaaggctaaatctaaaagtcacacatttatgaaataaaaggtctcccattattattgtgtgggagtctaagtctctttgtaggtctctaaggacttgctttatgaatctgggtgctcctgtattgggtgcatatatatttaggatagttagctcttcttgtcgaattgatccctttaccattatgtaatggccttctttgtctcttttgatctttgttggtttaaagtctgttttatcagagactaggattgcaacccctgccttttttttgttttccatttgcttggtagatcttcctccatccctttattttgagcctacgtgtgtctctgcacgtgagatgggtttcctgaatatagcacactgatgagtcttgactctttatccaatttgccagtctgtgtcttttaattggagcatttagcccatttacatttaaggttaatattgttatgtgtgaatttgatcctgtcattatgatattagcaggttattttgctcgttagttgatgcagtttcttcctagccttgatggtctttacaatttggcatgtttttgcagtgcctggtaccggttgttcctttccatgtttagtgcttccttcaggagctcttgtagggcaggcctggtggtgacaaactctctcagcatttgcttgtctgtaaagtattttatttctccttcacttatgaagtttagtttggctgcatatgaaattctggggtgaaaatccttttctttaagaatgttgaatattggcccccactctcttctggcttgtagagtttctgctgagagatcagctgttagtctgatgggcttccctttgtgggtaacccgacctttctctctggctacccttaacattttttccttcatttcaactttggtgaatctgacaattatgtgtcttggagttgctcttctcgaggagtatctttgtggcatcctctatatttcctgaatttgaatgttggcctgacttgctagatataatgtggcacatatacgccatagaatactatgcagccataaaaaatgatgagttcatgtcctttgtagggacatggatgaagctggaaaccatcattctcagcaaagtatagcaaggacaaaaaaacaaacaccgcataggtgggaattgaacaatgagaacacttggacacaggaaggggaacatcacacactggggcctgttgtggggtgggggaggggggagggatagcattaggagatatacctaatgtaaatgatgagttaatgggtgcagcacaccaacatggcacatgtatacatatgtaacaaacctgcatgttgtgcacatgtaccctacaacttaaagtataatttaaatatatatatatataaagaaataaaaggttgaacttgatgacataaaatgtttaaaattcttcatcaaattaataataagaactgacgtttgttaatatggtttggatctgtgttcccacctaaaactcaggttgaaatgtagtccctgatgctacaggtggggcctggtgggaggtgattgaatcatggggggagtttccaacgatttagtaccatccctctagtcctgttctcacgatagagttctcatgagatctggttgtttaaaagtgtgtgggccgggcgtggtggtgcacgcctgtaatcccagcactttgggaggctgaagcaagcagatcatgaggtcagaagatagagatcattctggctaatatggtgaaaccccatctctactaaaaataaaaaaaaattagccaggtgtggtggcacgcacctgtaatcccagctacttgggaggctgaggcaggagaatcccttgaacctgggaggtggaggttgcagtgagccgagatcatgccactgcactccagcctgggcgaaagagacagactccatctcaaaaataaaaataaaaataaaaataaaaataaaaataaaaatgtgtgtggtacctcccctgtctctctcttcctcctgtgctggccatgtaagatgtgcctgcttcctctcaatcttccaccatgattgaaagtttcctgaggcctcccaggaagctgagtagatgccagcatcatgcttcctgtacagcctgcagaaccatgagccaattaaaccttttttttttttatagattacccagttgcaggtatttctttgtagcagcgtgataatggactaataaatttggatagcatttataataatgcttatgtatattgaatcatgtaattttcactatgatttatgagaaaggggctgggtgtggtggctcacgcctgtaatcccagcactttgggaggctgaggtgggcagatcgcctgaggtcaggagttcaagaccagcttgactaacatggtgaaaccccacctctagtacaaatacaaaaattagccaggtgtggtggcatgcacctgcaatcccagctactcaggaggctgaggcaggagaatcgattgaacctgggaggtggaggttgcagtgaggcgagatcacgccattgcactccagcctgggtgacaagagcgaaactccgtcacaataaaaaaaaaattaaaagataggtagttattctcatttgactgttaattacataactcattaaatgtatcaccacgactaaaataatatgcagaagtgtcatataatgttgtgcaggttataggcatacactgtgcaacctgacatctgtgagtaggggttgagggttgtttggtcgggggtcattcccgcagcctttgatgctacagaaatgccctcactcatctacctcattgtttatatgtttagcattcaagaaaatccaagggccactttctctagaaagtctgtcctggcccaacttggcacatacaacaaggtaaaactgacctctttcttctccaatggcccattgttctttccacaaactactctcacaggaactttaacattttgtcttgcttatttatttactcatctgactccttcaccagattgcaggctacttgagggcaggaactcttcttatttgtctttgcataaatgtttcccagcataggtcacacacatagtgttgaataatttttcgttgaataaataccaaggtccagagagatattctactgaatggcaatttgcaagatattgattttctttgctcccatttggtgatattgttaaacttttactggagggcaaaattcatagttgtcgcttcacatgtgaattagcaaggaggcaatctcagctctaaaatctttacacttatcctaacacccccatcagctcacactattaaacattatagataaatactgcaacattaagttttgtggcagtgcaaataaaagcagtaacaagttatgtaattataccactcttttttaaaaaaattattaaatgctaacacttctccaattataaccattcaattactactcactgcctaatgtccaaaattcttaacatgtcctagaatggtctctaaaacctggctcttgtctatgtctctaaatttatctcctgctagcccctcctactccccactcccatccatgccacagcatacatgtgccctatattcagataacattttgcaaattgaaattgcaagttgcaattgccctaatccaatctcaactctttaaatcatctcacaattttacgctctggcatattctgccacttcagctcagaatacccttttcacttttgtagcacttcaagctgtcattcataattcaagtctcagcttaaaagccacatcatatcctcaatgaaacctcctcgcccagccctagcagaatcatgggatccttgctgaaaacttctagggttcaaggtgcacaacttgtatccacagtgtttaacacaatattgtatttgtcattgtttatcacatttctcatctatcttccacctttttgaaagcaaggattgagtttggcttattcctgaatccctaatgtctaacgaacgaccgtcataaagtagccacttcaccaaggagggatgaagcagcaaacaggaaagcctggttcaggcccatctttaatcactagttttgtgaaaaagttcactgctgcttcccacagcctgggatttggttttgacatgattatttttcttttgcagcataggaaggaagctcatgagaagaattttagaaaaatcaacctcgatttttcccatggctgtgcctcacctagcagactatctcaggacagcttcctggaaacacagcagcagaaagtaagctgcatttatttacttttttaaaaatgtgttctgatactttttgattattacaaagaatcttgctgggtgatactgcagtggactgacctgatatatgtttccttcttttttcagtgaattgttcagttcttttttggaatactgtgggtgagagcttcaggcagcacagagccttagaagtatgctttgggcttggattgggacacggatttagtaattccacaactcaaaagcaacttctgagataaaagctgaatttgtaaatatgtgagataccctgaacctagaagatgagatataagtaatgtagtttaggtggttttggtgtattatctatctccaaaatcaaaggaaatggaaggattcctctaagaatcatcagtaaaaatgtgagttttgctcatatttgcattttgcctaattctaaccctccataatttattgactgaaagctaaagaatattaagagaaaatgacaaaggtaattttccttccactgtgtcatttcctatcaactatgcgatttctttattttttaagttttgaaaaattttagaatagttttatgtttctataaaaattgctaagatagtacagatttcccatatatgctgtatgcagtatcccttcttgttaacattttatattgctatggcaccttggttacaatattgacacatatttattacctattttgagatggagttttgctctgtcacccaggctgtagtgcagaggtgtgatctcggctcactgcaacctccatctcctgggctcaagtgatcctcggtctcctgagtagctgggactacaggtgtgcatcatcacacctggctaattttttttttatttttggtagatacagggtttcaccatattgcccaagctggtcttgaactcctgagctcaagtgatcctcccacatcggcctcccaaagtgctgggattacaggtgtgagcctctgtgtccagccccatgttttatttatatttattaactttttctcttaatcccttttctgttccaggatcccatccaagataccacattgcatttagttgtcatgtctccttaagctcttcttggctgttagctttctcagactttttttgttttttgagacctcattcgttttgaggagtaaaggtcaggcatcttgtataatgtcctttagttggcatttgtcatatatttttctcatgattagaatacgctcgtatgtttttgggaagatgaatgcagaagaaaagtaccatttacatcccatcatgtcaaggacacatcttatcaacatgacttcactgttgatgttgaccttgacttcctgtctggggtagtgtttgccatgctactccactgtaaagtcattcttttttatcctccctttccatagtgctccctgtggaaggaagtccctatgtgcagtccacatttaaggaatggggagcaatgttccatctctgtgaggttaggaaatccacattatcagaaagtctgcaaaatcagatacctacagaaattattcggaattcttctgcatagagacttatctattcttcccaatttatttattccataatttgtttcaatatagacttggatttttaatatattgggttgtaatacaataccacatagcttattttattgtgcaaattatcccacctttggtagttaggagctcgttcacttggctcctctgtccttttggcatcattgtagattttttaactctttatttatttatttaacacttccttactttttggtactatataatgattcatgttcaacttgcttatgttctgccctagttctagaatcaaccatttctccaaggagtcctggttccttttattgaaaaattgtattagaaaccaaaatctgtgcactagatatgttcattgctactgtggtattcttgcttctaggccctcttaattgacatagaaggagaatatatgtctgcatactaacccatctatatgtatttacctatatctatagatatttctatatgtacttatctgtaccgttattaagcaaaacatgaattcatactgatatatctgactctaatccattaccacacagatcattctaaacttatccctttgcttatccataacctcccactccaactgtgagaaatatggctcccatattcaccatccatttatttaattgttcgattccagtatacatctatagcagcaacagaattattaactgtgtccccatgaacaagaactcaattaattttaaaactaccatttttaaattatttccaaactttttatttctaactttgaattttcttaagcctgggagaaattttgtaggaaaaagaggaataaatgccaagacaaatgaaatgtcacaaaattaaagaatatgcatatggctaaaaaaaacctctatattaagccaggtagaaattcagtaagcctgataaagaacatggaagaagatatttacatttaggatatttagattagtaagctataatagaaaaataaaaccaatacgtcacaatcacatgggaagtaggaattaagatacacacaaaaagcatcagtgttggcaggtgggtaaatgaatccacaccagagacacagattccagaaagcagagaaaagtaaaattcctaatgattaatcaaactgtcagaggccaagagatctactgaaaataagaaagggttgaagggttgagatatcagtatccagatatccaagccaaggaaaaatttgatggtattcaggcacagggtcttgtcagcacttcacctcagggattttacagggtcctttgaggaaatgtctaagcatgtatgaattaaggcttataagaaaataatttaagaggatttagctaaaattaagcattgaagaatgttttttacgatgcaacacaaagctgtctccctcaagaagccttctgagatagccttttagacacagcacaatagaatgttcatatgatagttttcatcaaatattatttgcatatgtttgtgagctagagtgaggtctagaggatcaaggactgtaacttagttccttttgatcatcagcacctagcactgtgcttggcaatgagtgataactcagtacttttgtatcgagtaaaagaaagaaagaaaaagagagaatcccagccacataaacactcagtttatgaacatagagttgaaaaaaaaaaaaaaaaactccttccagcactaaatcaatacccttccaattgaataggaagtagggccttgccatgttgagttctccaatgacttttcaaaaaacctttattgctgcaatcataggtaattcagtgactgtttaaaacctatgatgaaaataaattacctgagttcttttcattaatcttattattctgtagtcccatcataaatagctcactagcatcttttatctttatttttcagagtggtacagctaagaaattatatcattatgcatttgtgttgtgttctaatttctgcctgatgcatcaataatacatttaattgtgttattcttttctgcagacagttccatctttggaaattgctttagtgatacaaaggactggagggtagatattctgggtttgtcctctaattaaaatatgtcactggttagactcagaatacagacaattttttatcactgggagtctttaatcccaaactgttcatagaatgagcttatataaacactgagatttgacacattcttccagacttgatgaaaaaaaatatgatatcccaaagttcttgatttgaagaaaaagtgaactttgataactttggtgagattttcaatttcttggccaactacaatttatttctgagcagttaatttactttttgcataatgctacagaagaattttgagaacaaaggatatgtggaaagcgctctttttattttttgctttgaatgatactcataatattatgcagataatcactgaagttataaattttatgcatttaataatttttatacatttaataattttaacagataattttgaagtctattcattttcataaacttataggttgggaacattgggaaagtcgtttagttccttgggcttctgccaacttatgtgtaaaaatgggctaacattaattcaactacttttcttatttgaaaaaagacatacctgaatagaagcacttgaatttgataagggagaaatcacctagtgtgacatatttacttactttcatggagcacataaatctctgttcctttccttctcacaaccccattgcatcctcgaccccaagaaacccacacattaaagcttttctctcttaacaagagacttctaaaaatacttccaaggtagtaaggctgaaggaaaaacaacaacaaacaaccaccaacaaaaacacattacatatgtaatttaggaatcattagaaatatgaactcatttaggaaataagatttctaacaactgaatcaaatccatttaacaagtcattctgtaaaaccacaaaaagcccagaagtgcacactattcatttaatatctgaaaaaactctttgtaacaaaaggtttttacttaacccaaaacatttctttagccttggacaggaattaaggcttagtacagcttgatgcaaatgaaaggaactggcatttatcatgagtttcccatgaagctttacagatgcatagaggatgcaggaaaagtagagagtatgttagtgtgtgtctgagtgggtggccaagttgcttaacttggaatttaaggaatgtcctctttgaggaggtaataagtggagacctcaggttctatgggaagattactcaaagcataaagaacagcaggtgcaaagatctggaaatggaacagaaaatctccacatcactccccaatttaaagtaaaatgtggcttatactattttttttaaatgcatgattataggaacgacagtttgcatacaggtagaatatgccagatgtgacagagattggccagctagtgaccaatctcctttgttctccctcctgagaacatgtcaagacaatacatcacaggtacccttgcagcaggtatggtttcgtgaataaataaatgatgaccagtggactctggtggaagtttctggcccatgaaaacttccagggatgatccttcatgggttttttgcctttgccaacaactttgaaaggcatgtgtggaagactgcagagcccaagatgaaagagaactgggtctctgaaatgccacttgttttttgtttgtttgagacaagatctctctgttgcccaggctggagtgcaatggtgtgatcatagttcactgcagccttggtcttctgggttcaagtgatccttctgcctcagcctctcaagtagctggaactacaagtgtgtgctaccatgctgggcaaattttttttatttttattaaagaggtctggctatgttgcccaggctggtctcaaaatcctgggctcaagcaatcctcctgccttggcctcctaaagtgctgtgattacaggcataagccaccacacctggcctgaaatgacattggaaatagagctgtatgcttaccagaaacacttttgttctgacaaacatctacattttaaggtttgtttgttttatcagtgttggcctcaactaatgtgataagaatcattttctataggtttgggtgctgttctaaataacataatcataattaagctaccagcaatttaacaatgaaaaacccaggggaatatcttagatgcagagcaataacttattaaatgaaaagaataaagctgatgtatgttgggacagtcacagactcattggataaaatttcatgttttccaattccctggcacaggatcttagaagtggccattttacctccaaagatagattctctactgtatccaactaattgtgatgttaaacgtgagtatctgagagaaggtttgttttatagtggaaatccatggagttggccatattaacaaaaaggactgaattgtaaatatcagtaaataaagaatatctattgatacaagtcattttactaactcattcctcaagaatttccttgagcagatatacatatacttttttgttttgagacagagtctcactctgctgcccaagttggagtgcagtggcatgataatagcttactacagtcttgaactccgggactcaagtgatccactcacctcagcctccccagtagctaggactacagacatgtatcaccatgcttaattttttattttattttattttttggagacatagggcctctcttttttgcccaggctgctctcgaactcctggcctcaagtgatcctcctgccctggcatcccaaagtgctgggattacaggcatgagccatggcactcagcccacatatcattattggttatgcattattggctgttttgccaagattttgttttgttagttcacagtgttgagtgaatatatgtgtgactagttgattgaatggtcttaacttcttgaggcataacagaaaaacaattattttcctaactgctacctttaaaattctttgaagcgtatttcttccccaactctggataatctcttgtgcaaatcccaaactataaagccaattatattttaggaaagagtctcattttagtatctatgtcacaatttcctatattgcatgaagccatgaaatacagtctaataaacatttcattctctaatgcaaatgtctcccctgcagtttccattcaggcctattccagacttgtagagccacagtggagtagagaaaaccactctttactcttctctccttttgcttctttatcccacttgctctgctgcttcagattcttccaaaatctgggcaggagaggagcttatgagagaaacagcaggcaatagggtttttgttatgtggcacaccttatagctttctcgtctttggatttccctttaggtcaggaatccaaatgctggctctctcttgggatataaatggagtccccatggggccatctgtagtgcattcttctctgacatgtgttgtacatttccgggctgacctctagtaacagctcgtgcacctgttgtcaattcaatttaccccacagcctctaaacactggggcttctttgcctggtagatagccctcttagctgaagtgccattaggtgtgttgtgattatcttttaagacatccgctagaccaatgggaaatacatacatccaagctgcatcaagtgcaaggaacttcagctactgcattccctctctatcctgctccccatcacaagaagctctagacagacatccatcttcggaattctctagaaaaaaagcatgaccagtctatgcttacatgcatttgtaccacataaactcctacaaacatttttaaggctctcctcaaattgtgtctttacattccattctaatacactggattagcctttgagtttctgctgcttggaaagtttctggacaagcaacaagagtcctttctctccatctagcagacaacttggtatctttgagaagacctcttgaaaagcacttctttcacatgaacggagcacaactttccaatctacagagggcaggagaaaggccaagggtctgcctcagtagatctaagactccctaccataataagaaattccattccacaaagacatttggcttctctttaatagggtgaatgggagttcaaatatcacttaggcaacctcaagctctagggggattgtctggtggctcaagcactattatctggggctagagcccaaatataaagataatagagaaggtttcattttccatcctattacagttttaaagcaaatatttattatgagctctgtatgaagaattttataatcatcatctcctttaatcctcataacaattttatgtggtagagaggatgagtccccaatttcaggtttaatcacatggcaactcagcaaattggtccaggtcatcaaacaccttgtcagtcagcacactaggaatctgacccagagctgagtaatgtcattcttttaactgtctcaatgttagaagatttatgagaagacaaatattataaaatcacatttaatcagcatgagtgttagtgttggctatataaatccaagataattaactcaaaactttttagatgttataaggattgacttagaaaatttaaaatttataattttctaaataccaatgacagccaaatggaaaatctaatgggaaaaaaaaagatctaatgcaagactgcaccaccaataacattaataacaaaatttacattatttagaaatagccttaactagaaatctgaaagtttatataaaaatccctattaaggtgctgagtgcggtggcttatgcctgtaatcctagcactttgggaggctgaggtgggcggaccatgaggtcaggagttcgagaccagcttggccaacatagtgaaaccctgtctgtactaaaaatacaaaaattagcctggcatggtggtgcatgcctgtagtcccagttactcaggagtctgaggcaagagaatcgcttgaacctgggaggtggaggttgcggtgagccaagatcgcgccactacacatactccagcttgggcaacagagtcagactgtgtaaaaaaaaaaaaaaaaaattagtaaaatatacaataattatccaagagatatgttatagatttatttgaaaagtctgaatatgtcaaaattactaagtctgttaaaattaatttataattaatcacaattcaaaattaaaatatcccagtggaatatagttgtgaatctgacataatatacttcctggaagtacaggtgagcaggtgagagaaaaaaagataaccaaagaaatacattaacaaaagacagtacagcaagttgtaaatattcaatctatatatttttaaaagcatcatgtgtttgctggtcatcagtttattgactctgaactccatatccatccttctttgctgctctgtgaaaatggagctggtacctttcactattcgttctttgttggctggctggatgttaggatgttgggtttggtcagtaaagggtgctagagaggaactgcaggaggaaagggttttacttctctgttctggtattcttgcttgtttgacaaaactccacagtgcacctgatttttctagcactattcctgcagtgcagaacagctagcagattcctggaccaccccactttgacagttttgagtcaagtgcctctgagataccttctcatgagctactttccctaaaatcactgctctgctctctccaatctttgtgagaattggaggagggcaggagtctggatcaaacaaggatatggaaacaaccttattatcattaatgatccgatgatgataaaagataaagaggtttaggattttgtggtatgatgaccacagtgattgttaaacacttacctttttttttttctgttacagattgggttcctacacaattcagaactcaacacaccctttgcacttccttcctgtacagacatgttattatccacgagttccagttttgttacccctggaggctgcttaaacaagtagacctaatgcattctctatttcttccacaagagaaaatgtgagctacacagagtaagacagagtcagagaaaagagaaagaattattcaatcaaaatatcatttcagtactgctaagtccttgattagaatttctcaagtggggtctgttgattgtcagcatcagaagtaactggaagtaccaggtaaataactctagctcacctcctaagattctcattccagaagtttgtgggtggggccctgcaatctgcataatttgagccttcagctgattttgatgcagatggtccaagagctactctttgagaaccaattctgagataaatgaatgttttagaaatattaaaacagatttcaagacatcactaaattgaacaagcaagaaaagatgtcttttatatcaacacatcatccaaaagctttggattccattccaaatggcagtttatgcctgtatcaggagctaaggtgattgagagtgagactacaggtaattagagaaagaaagaagagaaaacctgagtgctagagctagggctaatgtatattgctgagagtcaacaaagaaaaaaaatagaacaagtcagtggcttgtaataagactgaatcaacagcttcctgtccttattgcaggatctagtgggacagctcagcttggggacacagaatcagaaagtcaggcctctcaagtcctaacagcaataaagagtttagcccaattctaatgacagggtagatatctggtaatctccacactggtgctgtcatcttgatcttggtttggctttcatcagctcttgactgatccaacgtgactagtctccctgcctccaagctcaatccacttcaatcgtttctctcccataatatttcagtagcctcccattgcctacctacagcaggggtccccaaccttggggctgtggactggtaccagtccatggcctgttaggaaccggctgcacagccagaggtgagcgactggtgagcaggcattactgcctgagctccacctcctgtcagatctgggtggcattagattctcacaggagtgtgaaccctgttgtgagctgcacatgcgagggatctaggctgcattctccttataagaatctaatgcctgatgatctgagatggaacagtttcatccccaaaccatccccgccctgctctgtctgtgcaaaaattgtctttcacgaaactggtccctagtgccaaaaaagttggggactgctggcttacaggataaagtccagtttctctctaaggggcatgtggagggggtcacctctcctctatctaaagtagattagttggatttcaatccattttttatactgacaactgtgtgatgttaggcaaatgatctaacttccctggctgaagttttctcatctgtaaaacatagacatgagactcaatgggacactattcacatgaactatgatgtaaagagcatcctctggaggagggcaatgaagcagcctgaaaatacacacttcacatgattgccaggaagattgatatagtgcacacaaagtctatatgatagtgcttggcacacactcagtcttcagtaagggttgacttggatcattattgcccctctgttatttcttacatacccttgctttccattcttaccaagtaactcatgatttttcaaatgatgctgtttgatacctcacactttagctccactgttttttcagtgcaaatgccctcccctcttcacatgatgaactcctactcatcccttaagtcctagctcagatgtctaatctctgtggcactccctgattccaccccaaacagtttttaaacctgtattttcattaaagctatataaagtccacacctccattattacaataaatcctctccacagtaataagcctttcatgttgacagtcttctacaggaagagtatgtctcaaactgtgccattagttataccaccttcaaaacggatgccatatccttctaaaattttactgtaatctacttaatccttttctgtaaatcaattcataattctacttatataaatttattttaaatgaaactttatataattcataaaaaattaatgcatagttattctaaagtaaataataattacaatacaataaaaacgtcatatccatctactaactcatccattagcagcactcttatgggaaaatctgtactgatatataaaagctctttcagtgcaaagatatctgtctttatatccccagtacctattataatgttggtacagagcaacatcttgacaatttgaattgccatactccttcagaaagccctggcttcaaatcttgactttaacaaggagaaattaatttacagatatttataaatttaaaatctactattagaatgagattttgcagaaaataaaattcacccgaatattgtttatctatggaaacaagattctcaaatctgcaactgagcatatagaaaactaatacgaaagaatatcctttgaattaactgagaaaaaattttcgttacccaccaagaaacttttttcttttggttatttagaactatgacattcttcttggccaatagttacatcagagttaaatatgtgcctcacaacagctgaaagcctgtggtgtttgtacactctttctgctagtgttgacttcacttttgagttttctcttgtccatttggggggttatgttttactattaaaacttttaaaaagtcatttatctaatatttttattgagccagagaaataactaattcattaattaaataagcaacccaataaatcaatggatgaacagattgatggataaatacacaaggtcatgagcagtccttagatatgctaatgcaattgaccagctcagctgggggaaaatgagtaaacagacaaaccttttgtgacatgtaaattaaaaagcaccttgatggacatatttttttcacttcttagtctcttgttacaacaacttgaaggcacagcctgttgacaccaaaaccagttcagtttagcaacttgggacatagactgtaagaaataacaactgtgcagatgagaaacaatagaggtgggtgttggatctgctaagaaagtgaaccacatatctttctctccgtgaagcacaagacatatgaaaagaaaaaacaaacaaacaaaaaaacccactaactctgatgcagaagcaaacagatactacaattgtgctggcaaatggtaaactcacagccaggaaaggggcaactgattttctttgctatttatgtactaaaatcactggtcccattgggaactagcttacttaaaaggctacataggctgggtgcagtggcttatgcatgtaatcccaacactttgggaggctgaggtgggcagatcacgaggtcagaagttcgagacaagcctgaccaacatggtgaaaccccatctctactaaaaatacaaaaattagtcaggcgtggtggcatgcgcctgtaatcccagctactcaggaggctgaggcagaagaatcatttgaacccaggagacggaggttgcagtgagccaacatcatgtcactgcactccagtctgggtgacagagtaagactccatctcaaaaaaaaaaaaaaaacaactacataatattataattttatttattaaaatcgcttccacgttttttatttcaaagcttgaacaatactacatatgcattgattacaattcaaacttaatggaattctgtggtagcataaatgctgatttgtttttaaatgatagcataaatgctgatttgttttaagtataaaacaaatcactcagaaaaaaactggaataaaatactttcttcttctccaacagaaatctcataattatatctatttggaaaatatatgaaacataaatttacatgaagtagaaaataatttggatgtcatgtaagaagtcttatatattttagtatatagaaggattctataagcatatgaacactatgatgaaaaaatttctttttcagaaagcttatttaaaaccaacaattacacagtcactttgaaatagcacattataattttgcatagacactttgatttcagagttaataaatgtaaccaatacttcaaaaagctgacttattttccaagtaatatatccaactgtttatgcacattttattaccatctttctctcacacacttacatataaaagagaatgaatattcacaaatcagaatttatcctaaaaattttagaaaatgaagcatccaggaacacagactaaaaatctgcaagtagaatttacaacttcctaaaattaatttgagataatcaaaaattcaagttcacatacaaagtcagtgttattgaaatccttttatgaagcccaacatgtaggaagcaagcaaaaaggctacacaactgcaatagcaaataaaatcaactaaagttatttaagcattaaattcctacaatactagcgtttcgaaaaagcgttgtctttttattcatctcgaaaatgcatgtttttttgaagccatcatggaaaccaagagacaatttcacttaacttttaacgtttatcaccttaaaactgggtttttataggtgagagaactgatttgggagtcaaatggcctgggtcttagtttctgaaatttactactcattagcttatttgacctttagcaacttcatcataaaaaacttctctgagtcttaattgctttttctacaaaacattaacaagtatctttgccaccagaaggattaaattagacaaagtatatagagcagatatggattccaatcacgattttttagttatgaaaaagtacatgtaagtaaaagtcattgcgttattagagattgataagttcattacagtagaaaacttgtttaaatgtatgcaaaataaacctaggaaatgaagggtacattagtgttttctgttttttaatttcaaactcaacagtaaaagtactgtcataaattctatgtaaaacacatgtgactcttcatatgagctgattatttagacttaaaatatcacttgggagcttgtcaaagtaaaacctgttgaatttaggaaagccagattaaattttcgactatgggaagttaaaaattatactgtgagttgaagaggaggatgacatcaatcacatcttcttttgacccattcttaacgtgcactatgatgtacatcacagcttcatcttcttaactcctgtgttcaaagcattgttaatacagatcagtgtcaaaataaaaggtgcttttaagacacttttttgggaacagtagcataaatttaggcaagacctctaatctctaacttctgaatttcttataaatcaatgtatttttgcattatttacattcatgaggcacctcctcatgttctcttgcctccccaagatgttagagttctatgcctaatcatgaattcttgcctgagtcagtgacaatatttaagtctaaaaaaaaatttagtttatcaactgcctttctctctctctctctctctctctctcacacacacacacacacacacacacatgccatgtcctaacttgagcaaatcacagttcaaggaatccacaaataacttgtcatcactttgcacatgtagaaaagaagtgacagaaatcacatttggaacgggacacagtactaccctcttacctttcatctgtctcgttggctttatttgaatgaaaacagtcaccatcatatccaccatcttctcattcatgtttaagatgtcgcaaaatttcttatcaagctgatacattacattttcccaaatttcacatttagaaaaaattttaagaaatagcgagatgaacaaaaaggttttgtttctccaaaggtctttcgcagtcttcccagttctgaatggcaatggtcttcaactctgcagcaattatgggctgtactcctcaaattcacattttgggaatgcagaagccttgtgtgtgtgtgtgtgtgtgtgtgtgtgcgttggaaggggcagtttatatgtaataccatgcagatccatagtctatgaacatcaccaaggttaaccaaccttaaatgcaactatcagccccttgccagaatctgcagcaacctccttttttatatatctggttcaaatttccccttgctgacaatttaaaaataattctctctctctctatctctccatagctctctgtcactctgtctttctggatgaatacatacatagacaaatgagggagaattttctctctctctctctcatgcacacgcacacacacacacacacacacaagcacacacacacaatcacccaatgcaggcagcttgctaaaggatataactctaattatggtttcgacccaattccccctggagtccccaaattaaggttcaaaattatgagagcagtataaaggagaaatttactttataaaaattgtaatatcttagtagcccaaatccctttactatcaaaaagaagctgaaaacggcacattcatccctatgtcaaggtctgatacatgctcaaaatgggaaaaagaaaaagaaaatgagttattttcttctaattaaaagcttagttcagaatgagaaaattgaggtggaaggagtctgctttttatgaaagaagtaataaccaggcacaagatagtttagatcttgcctaaatgaattgaaactgcacagttaacataaaagagagatgtcaaacaatctttgccattgccaatcattttgccctaagaatatacaaatccccagatatcaggtttttagtgggcacagattatattttcaaaatttattttttttctcagatcttttgatttagccacacttgcctcttaaatgttccctgaatacacgacactccttccttctgtgaaattttgcctaagttatctttatccgaaatgttgttacttcttgtctccaggctcctccatttcaggaataaattatgaaatcagaaatgttaattttccgtaataagggaatcttattaaaaagacttgagagctggaataatttagaccaaaagttacaggtcctattccgttttgccacagagtgcgggctcactataacccttagcatgctctaaggggttattagggtctccaggtaatattgcataattgctaatgcattataatttttggaagacatttatacccatagtttgttgaatctatatttaccagttcttctggataaacaccttctgttttctattaaaaatgattttacctttacatctaacagttgtctcagtaggcaggcatgaaattagtatgatcttaggaactgagatttatttaatgtgacaaaattccagtccactgtcttcatctgggattaacttcacattttaaaagtgtatgctgcttctatacttcatttttataaagaatattacatttgatggggaataattaaggcaaaatgaaaactgagctataattttacacctatcatcttgctaaaaactagtcttgtcttgtattttcttgccttagccactctcttttgccaaattctcctaaatacacctctctcattatataaagcagtcacaacaattaactattggggaggtaaaggtggaaagaggtattcaaagcaagcaagtaccttacataacctgtaggtccttgaggtacatatgcaaacaaaactgtaatcatagacctcaatcatcctaataagtcatgaatcatataatagcaatttcaactgtaataagtaacataaccagttatattttgcactaaaaatatcaagtatgaagaaggcatctaactatttatttgtcaaactagacacttagatggactgttcatttcaaagcatgttttgggatctttttttttcttttcaccaaaggtagtcagtggctgaaatgtctatatggaagaacagaaagcccaccctgctactttttaaatcttttatagcagaaaagtgactgatagaaggatttaccagaatggtcatagagcaagtgagcagggacatagtttagcattaattccctagaatgctaaggccagatgaaatcagatggagtgaaccgtgttgatcaagctatgcttcatatttcatgagagcagtgtcttagtgttggtgtttgctaacagagaagctatatcaaaaacagctttcagcttttgatttctgaaaagtagtgaatatccacatagaatagtgactgacatttaattacatagatcatgtctaaaccacaatccagtcctaagcttctcaaatcttctaggatgtctgttaaaaatgttaattcccatgctccaattccaagcactctcatttactggctctatagggctcaaagatctacattttaaacatctcctgagcaatttaatccacccatcatcatatattgcacgtctgtacccagcctggtcaacaatgtagtcatgatagagtggtagaaatgggctaggtgcagtggctcatgcctgtaatctcagcactttggtaggccaaggcgggtggatcacctgaggtcaggagttcgagaccagcctggccaacatggtgaaaccccgtctctattaaaaatacaaaaattagctgggcatggtggcgcgtgcctgtaatcccagctactgggggagctgagggaggaggatcgtttgaacctgggaagcagaggttgcagtgaacggagatcatgccactgcactccagcctgggcaatagaatgactccaactcaaaaaaaaaaaaagaaagaaagaaagaaagaaagaaagaaaggaaggaaggaagaaagcaagcaagcaagcaaagcaaagcaagaaaagaaagaaaggaagggaaaaataaataaatgaatctctgtgtggctgatctaagttaggggcctttctttagggaggctaattcacctgttatccagtttgaggaaacatccaggctgaacctttctagcttctcaagttagaatacaatgatttggggtttcacacgggatactatcagatgatattttagatacaaattgatgtccttttaaaaagtcatgaacaaaatgtaactgatattatgttttaattagcttcagtcagcctacaaatatatgcattttgacgatgttaccaaatttgctgcccattttacttaaaatcaatagaacagtttgttgtgaattcaacaatccttacagaaaatctgtcctctttgtggtaaggtagccaataaaagtttattaatattcactatagtaacaagtaataaaaaggcatctaaaatttttactttaaaagtaattgctctagacatttaagtaatctgattgatttaactctcgagtgatgatggtatcatatagcctccatctaatgagcattgagctgctttcaaagcagtgtcatatatatgaattcatttgatatttacaaggtccacagagcatcttaaagtttagagagacatgttcttgaactggttctgtgaactgtagtttcatagatttttccccccattggattttcttatcacataaaatagcagtactacaggaaaaaaaaaaaaagatcaagccaaactcagaacttatcagctctcatacacaatcattttctcctacaccgataggttgtgaggctggcaaatttctatgaaagaactttgtgacagtcccattagacaatacccttatgtatcccaacaactttaaactcaagcaatattgaactattctagttttctgcaggtgccatgctgtttcatgattacatgactttgtccaactgtcccctctgcctgggacttctggcttccctctcttttctgcctggacaaatcctattttccctctaaaactctgtttaaacatcatctccatggaaactttcttctctgttctccatctgtattatttgtttacaaacccaacttcccctgactttcagcactcaaaaggcaaatcatgcatcttattcatcttagtatcttcatggtgtctcctaaggctaaaaaatcaatgaccaatctgaaacacaatattaaaagtgactacttttctcactaaatccatttgaatcacattaataagaataaaataactaggccagatgtggtggctcatgcctgtaatcccagcactttgggagactgaggcaggtggatcatctgagctcaggagttcaaggccagcctggccaaaatggataaaccccatctctactaaaaatacaaaaattagcagggtgtggtggcaggcacctgtaatcccagctactccggaggctgaggcaggagaatcaattgaacctgggaggcagaggttgcagtgagctgagatcgcaccactgcactccagcctggtgaaagagcaagactccatctcaaaaataagaatacaacaacttaatagaaataatttatgactattatgtggacatgtgcttaaagcagttatcctacagccagttgattttttttaatttttcatttacattttcttttcagtaggaggatatcagagcagttcagaatgtagatgttgaagccagactgtgtgcaaagcctgactcttcctcttcatagccacctgacattggagaaggcattcagttatctgggcctcactctattttgtgtgaaatgactagaataacagtacttgtctcactggatttttgcagggattatgtgagtaaatgcatgcagagttcttaaaacaatacatggcacctagtggattctcaatactggcaatttaatagttagtacatctactaaaattgttaattacctatgatcaaaagtatacatacaaaacaaccctggatatatttattcctgtcacatccattcatgttccaacatgttcttttgaataaattcagatggttttcattcatttctttacccccatacttttactaaaggagctacatgggtaaaactatgtaattaagtatctaagttatcattgttccattaaatataatgcaaactgcatgtacaattgtaaatgttctaatagtcacattaagaataatataaacttacaggtgacacaaattttaatattgctttttttttcttttttgagacagagtctctctctgtagcccaggctggagtgcagtggcatgatcacggttcactgcagcctcaaactcctgggccaaagcaatccttctgtctcagcctcccaagtagatgggactacaggtgtgcaccaccacatccgtctttttttgtgtgtgtgcagatggagtctcactatgttgcctaggttggtgtcaaattcccagcctcaagtgatcctcctgtctcggcctcccaaagtgctatcattacaggtgtgagccaccacacccggcaataatactttttctttaaagaaattttaaaattattttacttttaatattattaaatattattttaaacatgcaatcaatataaaaactattgagatccattgtactagccacattttaggcactcactggctgcacatggccagtggtctgggcactggcaatggctttatttttattttaattttttttttttgagacagagtctcactctgtttcccaggctggagtgtagtggctcgatcttggctcactgcaacctccacctcccgggttcaagcaattctcctgcttctacctcccaagtagctgggactacagggacatgccgacacgaccagctaatttttagtagagacagggtttgaccgtgttgcccaggctggtctcgaactcctgagctcagacaatctgcccgcttaggtctcccaaagtgctagaattacaggcatgagccactgcaccaggccaggcaatggctttttaattcaaagatgctatttcaactcaataagatgcagctttttaaatttgtcactaggtggtgttggagacaaatacagtactgctccttgactagaggaaaagttcttaaaatgatgcagtcaaatcttacagtacagtgtgcctttggctatgctgattacaaattctacaaagatagttatgatgaactaacaggataaaattatcatcttataataagaaacaagcaacattaagaagcaaatacatcctaattctcgtctaacagctattctgaagtttgctgggcccagtttatgtgcaagaccatgaagttttaaaatttcatgaagttttaaaatttctgcaattcctgtaaagtgtttaatttcaccatataagttgcatctgatggaatctctttttatccccagaaggcttagggtgtttaaatcacttgtttagaactacagtttatttagccaaatttcttttccagttacactcttgaacaatacttcacacagcatccaaacaccatagcatctgcccttgaggtttgaataggtgatatttattttgcttgcaaaaactaactaggaacaataggatattttcacttaaggatgcaactctcaaaggtacatgtatttactttctcatcaattacaacagaaatggttttcaagggaatcattatttaaaactaatttctaactccattcctttaaccaattcaaaaatgcctctatcttcagttacttgactgtgttctttgcttctcagtctgaaaacacgtagacaaacaactcagggttccaagctcaccggaaatataattatgcttattatgttacaaagcttctgcacctttaatcagaaatgtcccctcttccaccaagtatgaggattgcacagtggcaggcactgctagctgcttacccaatcattcttcccatgttctttgtaaatataactcagattttgctcagattagctacgtatctaattaaatattcatcttcccactgttggttgaagctaggagtaagtcagacatactctgcttcttaagatataataatttgccaagaaatactgagggaagcatttgctgcttttgcaaggaacagataggtctggtaccattcttctctacttcttcctgccttgaacatgctgtctgctgccctgaggcaattagcaaggggatgaaaactatgaacagcaaaagagagagatctgggcctctaatgcattgttgtgagctgatcaactctaggataccaccttccttcaaacttggtatataaaaacacattaactcactattttatgctgctgttagttgagcgctgttacttatagctaaatttattcctaacatggacaccttcttgcttctgctccctaaccctcactttccttctcaccattcaataggagtctgtatgccctcccctcggagctgatttcatagggtttttcccctcataggtcactattcatggagttgagctagcaaagctcatcccagctaataaatatatttaatattattgttatatcataattctgactcataagtaaattcaaaggtgagatttctatgaaaactgggaaggaatagaaatagatagtgatgctaaccagcatgtaaggggccctttacattttacagaggccttttgcaaacactctttcatttgaccccacagcagctttgcacaataggtatgattaatagtcagtcctcttttacaggtatgaaaattgaaccttagaaagattaagttactcctcactgtcatacatccattataatataaacctcctgctggagacttggtatgacaataccataatttataccatttctacttaattcctttgcttgttgggatgataacaaagattaacatttatcaaagagataccagtgctgtaggcatttgctggaacaagagtgttatatgtgttattgcatttaatcctcacaatcctatagcctgataccattaatatacccattatagatgaggaaagtgagccattatccaaaaacaatccaccctcctcagccactcctcaggctgttcctgacttaatgcctacatagcatatccctatctttagctcctaagatgttggacttttgtttttgagtgaaaaccaagcttctaaactagactcacctgatcttctggcctgtgtttgtacaattatttatttccattgctgttagactgtaaatatcccctgtctttaagaacggcaacaatctggccaggagcagtggctcatgcctgtaatcctagcagtttgggaggctgaggcgggtggatcacttgaggtcaggagttcgagaccagcctggccaacatggtgaaaccctgtctctatgaaaaatacaaaaattagctgggtgtggtggcgcctgcctgtaatcccagctactcggaaagcagcaagccgagatcgcaccattgcactcccacttggggcacaagagcaaaactccatctccaaaaaaaaaaaaaaaaaaaaaaggcagcaatctgtctcatatcatgtaaaattgcagcattaaactatttgattttattttcctattgaaatgatgttaatgaattttggctctgaaagcctgtacttcaaaaaaaactcattggattcctgacttttaaattagcttacagttttctttcaactccaagaagaaggtttaatttaaaatgtacttaataagaaagtatgcacttcaaagataagcaaatacagttttcatgtggtttaaaacaaggactttattgatcaatacaaaggttggggtgggggaagaaaagtcaatacataaaacaagatacttgtacttattctactgatactattgacatcgtattactcttgaacaaaaaaaatcaggcagatttagacagtgggtgtttttttttacttggatataaatatgtaaatgattcctttttgttctgataacacaatggaataatgtgggttctagttttatccaaattctgccatttactggttgctagttactagaccattaacaagttgatgatactctctaagcctcagtttcctcatctctaaaataaagctaatatgttgacccctcatttttatttggaactttaagtaaactaatagatttaaattgtttggccaggcatggtggctcatgcctgtaacccagcactttgggaggctgaggtgggcagatcacctgaggtcaggagtttgaaaccagcccggccaacatgatgaaaccccatctctgctaaaaatacaaaataaaaattaaaaaaataaaaataaaaagttagctgggcatggtggtgggcgcatgtagtcccagctactagggaggctgaggcatgagaattgcttgaactcgggaggcagaggttgtagcgagctgagattgttccactgcactccagcctgggcgacagagaaagaccctatctcaaaaataaaataaaataataataataaatcgtttgccacatgcctgtatatagtatgcattcagcaagtataattcatactcttctctccttaaatctcccaaactaacttgattattttaaccatgcttctcaggtttgttagcttttgaaataaaggtatttctagaaacctgatactaggaaacagtgtattaaagaaataataaataaaagtcatttttaggatatagctatcacttttgtgacctaaataaatagtataggcttcatattataatgacattttgtatgctctttaaagcaattttatttattttcattttctttttaagccctggtgaatgtcctcattcttgggttttactttctagaaatgcttgaaaatagataaataacaatattgcattatgtagatgacaaaagacacgtacatgaaaaagtgtatatttccaaagaaaattggaaagatctccatctttctatataaaactttgaaatgacattgattaaattatagagaaaggctttgtttggtaattttcttaatccctagaaattccaatcatcttcaactgaagatggcaataacgctccttgtaagtaggacaacgggagctcatgacatccacagttgttggagaatgagatttctgactttcagaaaatcatgtgtctgaatttactgcaaataatttaaactgtggctttcaaagctgccccttagagtcccgtgataacttgtgcataagtctctcaagcctgctttacattctattttctttttatatatacctttctttatcactacaaagtgtccctattgagattcagagacaagacttaatttgattttgtgttaataataccatccagcataatggctgacacaggctgatagacagtcgatacaattttaatagagtaaaagagaaagaaaaaaaggaaagatggaaggaagtaaggagtagggaaagagggaggaagagaaggaaggagggaaggaaaaagaatgaaggaaggaaggaaggaaagaaggaaggaaggagggagggagggaggaaaagagtgaggaaaaaaggaaggaaaggaaagaagaaaggaagcaagggagggagggagggagggaggaaggaaggaacgaacgaaggaacgaacgaaggaaggaaggaaggaaggaagtctcctttgtatcagaattgaaagctcatatttatttcagtctgcctttcttaaagtgaccacattttgaactgagttcattacccaagcagtcattaaagcaatcctattgaaatactattactcctttaatttgtaatgacttcacctaacatcatcttttgtctgaaaggtttttatttgcagatggcattcagacaaaaggttagtcattttttaatcaaatttgaagcacagtaaatgacaattgctccttggtaaaagatgacaaaaaaaaaatctaagaaacttatgttttattttgtacttctccacagtgtggcagcagagacttaagaagtggaaaaagtcattcagagtctggttcagggagactcaggccacagagatattctcaacacatatacatgagaatcaaatggcaataggttcatctgtgctcacaagtcctgaacagaagaaaatattgcttaacaagcatcttatgtttgctgtaagatatgcattggcttagctgaagttcccgcagcatttaataggtaaaatctattggaaatgttaatatttcttttggactgaataaaggtctacataattggctgatttatatgatattaatctactgaaagaatgtccagttaattgcagcaaacctttattaaacaatgaacacaatctcgctttatggcagttctgttaaataaaaatagcagcaatcccatatgggtgtcacaaggattagatgagataacacactaggaagtgcatgtggcttgtgtggagtaagcggaagataaatgctgttacattgttaccattttctccactgctaccattgccattccacctccactcacctgataccactatgttccaggcagagaaacactagtcatttgtggagaaacaaaaatgactaacaggacagccctgctgtggaagagttccttctccagtaacagagatgaaggtgtaattaaataaccatgtcattgtatgatatgagaacaaatccatctacctccacatgtggcttgggatttgcctttacctttactattccagaagactctcgttcaggcaaataacttaacagctcattacgttaaagaaacttcctgaaaaatccatcagctcttcatgagaaagcatcaacagacaacaaactcatctttatcaacagcttgtgttggtgatatgtgagaagctggcattggacagataagtaccagaaggtagcataatacactatgcatcctttatcactggcatgaagaaatcagaaaaacatgggtttgaatcctagatctgcctcttactatctgcaggattgtgttcaatgtattaaataatcatcagcatatttttgtattcaccaatagtattttccccagtggtttgctgtgagagtggaatagtgtaacataggcagaaccttcagccttcacgtggcatgtgctaaatgctcaatacattttttctcatcttcctcttaatcattctctattaactgctctttcaacgttgctactttattgtttttagttagctgtcatttagataaccacaagaggaatgaaaagaatccaaatccttggatgaacaacggtacaaaacatatttagtccactctgttgggtctatggatctgtacgacctgaaggtaggagaaggatttaggagagcttggtttactaataagcctaaaatagcacctcctacacaagaaaacaggttaaaattatgatcaaacactagtcaggtttcctttcacaaaataggtgtaggtcctttcaacaaaagagctttgtaaattacagcagatgacaaagaccttgagaaaagtgaaggtattagccttgtgttgtcactctttctaacgtgaggctgtcagaccttctaaaaaaccagaaaaatgttaactgtaagatggtccctgaccctttggagacaatgcggtttccctgatgtaaccttacaaatgaaccatttgggtaatttgcatgagctgatattgtttctaagtggtatttatgctttcaaaaatgacagtaacatgatgtctttagtaacatttcccaaggagtgaacatgttcagttcagcagagaaaagcatagtgtcactaactccaggcaatcagattgctacaagcctaatgtttttcaacacagcacacagaggaaaaggacagatattttagaaaagacatcattgtattattgatatccacacaataaaatataactgcttcaagtaaagtgtatgtttccacagagaactcagagccaacaaaaacagccctaatgggaaaaatagtaactaaataattatggctcttctttcctcaaaagaattaaaattgcatttatggataagcaaacccaatcaacacagggtcgttggagggttacagaagaaacaagataaaaataaaaacggaaaaattcaaagtaaaaggagggatagaaataggaagcaactgttaaattaaaacaaaaaaaagtgaaagaaagactctctctcaattagatattctcagatatttgccctcacctctcacaaagagagtagtggaaaatataggctctccactccttcccaaggaaagcatcactatctaagcctgatgtattcatcttctgggggagatgtgtgcctgcaagaagacatttcattatttaccaattaattaattaactcattcatactttcttacttctatcctaaacatgacctatgaagtccatttgatttagccactacctatttcccagtattacctaacataatatgttcttacattctagctatcctaaatttctttcagtggcttcaccatctccctccttttctctagaaatgatttcttccttctttaccaagctggtttccacttatcctttaggttggtgcttaaccatcgcttccctagagatttccatatgcccctcaactaggctggagctcagtgatgggggctcctgatctggaaaaactctccacttctgtactgccatactcattgcatttataagtttctttctcaatgggtgctatagtttgaatgtgcaaagatcatgtgttggaaacttaattcccagtgcatttgtgttaagaagtaggaactttaggctgagtgaggtggctcatgcctgtaatcccagcactttgggaggcagagacgggtggatcacgaggtcaggaaatcgagaccatcctggttaacacggcgaaaccccgtctctactaaaaatacaaaaaaattagctatgcgtcgttgcaggcgcctgtagtcccagctactcaggaggctgaggcaggagaatggcgtgaatcctggaggcggagcttgcagtgagccgagattgtgtcactgcactccagcctgtgacagagcgagactccgtctaaaaaaaagaaaagaagtaggaacttgagtaattagatcataaaggcttcagtctcataaatagattaatgtcatcatcacaggactggttcattatcccaaaagtgggttccttagaaaaggaggagtttggtccttcttgccttctctctctcttttgccatctgctcttccaccatgggatgacactacaagaaggcccttgcttgatgttcatccttcagccttggacttccagacttccagaagcatgagacaaataaatttctgttccttatacattacccagtctgtggtattctattatagtagcacaaaattggctaagagaatgaggtctgtctcttgtgttcaccagcgtgttatcatcttcttgcagaccagctgcaaagagtagtagctcaattgattattgttcaatgacagaataaacaaatcaagaaactggttgatgaatgaaaaacatctagcaaggaaacttatgttgagctctaaccttgagcaaagtgctatgagaagcaagggtgtaggtaagggaggaatcatagtgtcttcctaaatatcttcagaaaaagttgtcatttccccctttgttgtcccacgaataatacttgtatctcatgtataatatacataagttctcttcatatagcccaaagttgagtcaatgtacaaagtaatccagctctattgagtcatctaaaatctaggtcagaaactgtcacatgtgcatatcaaagggcagaataagtcctaccacaacaatcacccttttcctttcacccactgaaaactaatgaaaggacctggggagaagtacaggagagacaagattggtggatgttctttttctctctcaaactccccaaactaaattggttgttgacatctgtcagagtcactaatcaatatttagggtacttataaaaaggaaaggcttgcatcagtttcttctcctgtagacagctgagctgaagaatactcaggtctccctcagcacgagtcagaaaatctgtgcagaaccctgtggagttgtgtctgggaagagttttcgaacatgaagttatgcctgggaagaggaagtttaggaacatgaagttgtatctgagaagattttagcaacacatgaagtttaggaacatggagttgtgtctgaaacggtttaggaatgtgaagttgtgcctaggaaaaggaagtttaggaacacgaaattctatctgggaagagtttagaaacatgaagctgtgtctgggaagagtttggaaacatacacaatattagagactggttcctgattgcactctggagaataccaaagactggtggaggattggtacagcagcccatgtgtgcagagaatgtgatgtagcatgcctgggaaaaatgggtacagctcatcccaagtccatgaaacactcaggggatgtcagagaagatcctcatagctttttgtgaagaacaatggaaattctaaggcttcatgaacagctgaaaagtctaacatagataaaggggttgtacatcctccatgaaggcagggccacagtgaagctgaatatacactcccaggaaaataatgagtacaacatactcagaaacaaccacgtcagagtgggatccaggacccccttcctgtaaataaccataaacacaggtatgaagtatttttctccctccttactctgcctcacataccagaggagcccagtcataaatgacacaggaaagaaagcagagagttttgaacctgaaatgtgattgggaatttcaacgtcctaactttaataactaaaattaatcagaaagttatagaagattcccaatatgtgaatggaggcaaagaagcaggggaggtacatagtaaaattggagacagtttgtaaaagaaataaaaccgtcttgtgtttatgctccaatgaatcgaggtatttcaataaactggtatgtttctgttaatcattgattttttttatcctgcctaatacgagtcattacatgcctacactccttcagggttaagattatgccttacttatttctgtaacagcaaccctgttgctgacatattgactgacattcatcaagtacttgttgaagaactgctgtgcacataaattcaaatctcccttaacaaaaggttaaagaaacaatcatgggagtacaatgccaccactagtgcacctgtgcttggtaattaccctctctgcatgcacagctttccctgatacattgtagaagacctaaactaggaaacttctaataacctctaccatttactgtggggtttgctatgtggatgttatcctatttattccacacaaaagcctacggtggtattattcttcccatctcacacacaggacaacgaaagctttcagaagacaggggcttgcttcaaggtcatactgctagtaagaattgaacatgagatttcccatcccaagactttgagattccaaatcctgctcctattccaccctcccacatttttcatagtgcctcatccctgaatttggaataagatcaagggtagtacacacaccccctactccatcaaacattcactggctatccatgggatcaatatattggcctggcaagtccatagacagacacagtaagcacgaatgcctcaaatccggcatcaccctggggagttagttgcaggaaattgctttcttccctttcttcttctttttttcttcagcagtcagttctaagacacctagtagaaaccatttgcattttctctacagtggaggagaccctaaccctctaatcatcaaggaaacacatataggctgaacagcaacctgctggtgggagatgcagcgggtgaaggtgagcagaggaatcagtctatgaaaacttgaagctctcagccccattcagctctcaaccactcagggaggcctgaggacactgaaaggacctgaagaggtaggacctgccgaggtaagccattaccacggcggatgaaaatatccctacgctgtggtggagaagagtcatttttcatctgtatcaggaatggggttctactaagcttgtatttgaaattacacaattgaatcccctgtaagtcatctctgttctctgagcaggccagtgatttctaaatgtagaccacataggatgtggccgaactgccaggatattttcggggacactgaaacagctccttgataaacccctgcatagcctggagcccaacaggagagagtttgagccctactcaaaatcatgttcagtttaagtaacagctaagagttgactgcctcttatggaccatgcactgttttaagcactttaattgatttagtgaatcctcccaacaagcctataaagaaataccattattacatccatttatcccactgagcaaaccgaagaaaatggggcttgagtaattttcccacggtcacggttatcgactgattatttatgtctctccaccaaattcacatgctgaaatcctaacccccagtgtgatggtattaggaggtggggcctttgggaggtgattgagacttaagggtgaagctctcgtgaatgcgattaatgcccttataaaagaggtcccagggaactttgttgctctttcacccatgtgaggataccttgagaaatcagccatctatagcccagaagagccctgtattagtcagggttctctagagggacagaaataataggagagagagagatacacacacacacacacacacacacacacacgtatatgtatgtgtatatatacatatgtgtgtatatgtatgtgtatatatacacatatgtgtgtatatgtatgtgtatatacacatatgtgtgtatgtgtatgtgtatatacacatatgtgtgtatgtgtatgtgtatatacacatatgtgtgtatgtgtatgtgtatatacacatatgtgtgtatgtgtatatatacacatatgtgtgtgtatgtatgtgtatatatacacatatgtgtgtgtatgtatgtgtatatacacaaatgtgtgtgtatgtatgtgtatatatacacgtgtgtgtatgtatgtgtatatacacacgtgtgtgtatgtatgtgtatatatacacacgtgtgtatatgtatgatacacacgtgtgtgtatgtatgtgtgtatacacacgtgtgtgtatgtgtgtgtatacacgtgtgtgtatgtgtgtgtatacacacgtgtgtgtatgtgtgtgtatatatttatatatttatttatatatataaattatatataatttaattatatattaattttatatgtatagttaagtattagctgatcacaaggtcccacaataggccatttgcaagctaaggagcaaggaaagccagcccaagtcccaaaactgaagaacttggagtgcgatgtttgagggaaggaagcatccagcgcaggagaaggatgtaggctgggaggctaggcctgtctctcctttcacgtttttcggcctgctttatattctagccaagctggcaactgattagatggtgcccacccagattaagactgggtttgcctttcccagcccactgattcaaatgttaatctcctttggcaacaccctcacacagacacacccaggatcaatactttgcatccttcaatcccaatcaagttgacactcagtattaaccatcacaaggcccctcaccagaaccagccatactggcactctgatctcagttttccagcctccagagctgtgaaaaataaatgtttgtcgtttaagccaccaggtctactgtattttgttatagtagccagaattgactaagacagtcacacagctaagaattagtgcagctgggatttgaacccaggtgacctcattcttaagagctacatcatactcaagtgaataatgtctctgcttttacaggtcttagttaaaattcacagaagcgttattttctgtgggggtatctaattaagaagtgaactcagaacttggcttgatgtttcagtacagtgtgtagccctgagtaagcaatgtgttatgaagaagcccacagaggaaattttgcaagacaatctatttctccttttacctttaacttggatagtttatttttaaatgaaaaatgctgcctgcccacctgagaaaataatttaggaaaacatttctaccattcttgtttcaatatactttatccaaaatgtgtgatatttatagactacttcaattggggtaagcagtattcctgggttgacttttatgtggggaaaatgtatgctcttaaggcatataaagataccggagcattcttattccattatcttttaattaaattgccctctattatcatcttgagaagtagaattgtgaacttgttgaagcatagaattgggcatccagtacttttgtcataatcactgcatcttcttcaattcatttgtccttcagagctttatctcttttgtgcctttaattaccatctacaactacacccagctttgaaacacagtgctccttccacagggcagcatccaacaggggcatccagtgacatccaaaatattttcagtgaatattctaagcaagaaacagaacagatacacttttctcaatattaataacacacactaagaactgttccatgtaatttaatataaactctcattttattgtgtatacaactgccttcatgtgaaaaatggggccaatgatagaatagtccctttaattcccacatatggttgtggtaaggattcaatgaattcatgacataaacttcatgaacggacttaacacacagcatgttctatcaagtgtcagctcttgctctttttctttgatctctctacttggaggcttcacaagaatatcaaaaataacatatctaaaactgaattcatcctgttccctaggactacttgccatgccactactcccctaacttctctaactcaggaataacatcatcatatcaaaaatctggttgtagggttgtcatctaattattcctttcttgcattgcccaattgcaagtctcagagtggctgcctcaaaaatatatcttgactattcattatcttcacccaaagaaccacctcctccaatttggactactgaaatgccttcctaagtgctctctccaatttcattcttaatcatctcttacctttctcttcatagcagccagagtaatttctacccatgcaatggatggaagttgtttcaatgatgtgtctttctcagatgttccagaacaatgtggaaagcatgtgtgaattgtacaaaagcatcctcatccatggagagcattgtaataaaaaaaaaaaagctccatttaatagttcttagaagcagctgtctttcaaggcatgataccaactctacctcctctagagggtgatggggaaacatagcagttttgagagacaatttaaacactaattacttcaacatgtgtctgttatagttactgctgcattaatagaggcaaataagttgacaggtgattgtaaaatacaagactattttaatataatatgtgttaggatattttacttcagtctacacataatcatcccccatgccaattgactgaggagattcatttaacacttcagagactccaggaaaaaaaaaattgcaggcaccacattttttaacctctttatgagagctttctaaatgaataacattattgtacaaaatgttttaggcaaatatgtgtagagcaaaatacattttcacctgccaccgtatattctgcagcctcaactttttttttcttctagagacagagtcttgccctgtcacccaggctggtgcactcatagctcactgcagcctctaactcctgggctcaagcgatcttccggcctcctgagtagctatgactaaatgtgcatgccaccacacacagcttacagtatattctttatgactaatcctttctacccaaagcagtaaaagaaaaaaataagacaaaaaatgcaaactgctcctcaaatgctcctacccttaccccatccatctgtagcaaagtggctaaaatcatgagctctggagataaatcctacctctactagttactacctgtccaaccataggcaaaattctccattcctctaatgttaaaagcgttatctgtaaagtgaggatgaaaaaaaaatcacaatatgtatttcattagattattgaatggattaaataagttgatatttgtaaagtacttagaacattgcttagcacatagtaaaaaatatatatatttgcttatttttattcctgttgctaaggtataaatgtttgtgtccctgaaattccatgtgttgaatactaacattcaagctgatggtgtcaggagatggggtctttaggaggtgactagataatgaagacggagcccccataaggggataagtgcccttattaaaaaaaaagggggggacactattcaccaactgcagagagctagctagccccttccaccatgttaggttacagcaagaagattggtcctcattggacatcaagtccagtttgatcttgaacttcccagcctctagaaactgtgagaagtaattttctgttatttataaggtaccaagcttatggtattttgttaaagaatcctgaatgaactaagacacctatggtctttattttttatgtgtcaatgcctctgtgctagatgaggtgattaattctataggttgtgtgtgtgtgtctgtgtgtgtttaccaccgtcaaatgctatatttagtatgagcatgcactgttaacagtgacttgatatgatttagtcataaataatattccctggagccaggttaaatgtaaatatgcatcaattttggtaatttgaaatgacttagtcctcaataatattcactcatctttttcttttctcgtttccttttccttctttgcttccttccttccttccgtccttccttttactttccttctttctctttcttttctttcagacagaatcagtctctatcacccaggttggagtgcaatagtacaatcatagcccactgacacctcaaactcttgagctcaagtgatcctcctgcctcagcctcatgagcatatgggactacaggtgtgtgccaccacacctgggtaatttttttattaatattttcagacaaggtcttgctaggttgtccaggctggtctcaaactcctggactcaagcgatcctcttacctcagcctcccaaagtgctaagattacaggtgtgagccactgtgcctggacttttttgctttttgacacctttacatggaggctttgaagtactcttttaatgatatattggataatgtatttcttccttaaaacattaatatggatttagaatatccaaaatgtatgatatttctgccatgtttctttgccaacattttttccatcctgtgaaggggctcaggtttggtatgagtctgagcctctctcctcctcctttattttctccactcttgaaagaatggagagacatagacatatctgggtggtagtgtgggaagaataagctggcatgctcttctctgctcactcctattttcacctgcctcactgtggtagcctttctttgctccagcccttcttatggatggttaacagtgtctatcattcttggggttagggtgtgagcccatttggctctcacactaaacagatgttttggcttccatgttttccctattatttccccatgtttgtccagaatcagataagaatgaggtgctatttattgtgtgtcccctagacattcccaaaaatgtttatgtgactgtaagctcttgcatctgatttttcctgaagtgttgtctcattgagcttctttctgacttatgcaatagccactatgacttttttttcttatgcttctttcaattctgtgaatatatccagttctttttcatttttggcttttacacctgctaatgttttgcctttttactcttcacttacttaacacttattcgttctttaggtttcattttaaatataaattcttcagggaaaccttctaagtcagtctcgtgttattcccttccataccatctaatctttttcttcctatcacttattttttgaaatattttctgtctatctccattatcagattgtaagggccatgaaagcaaagagtgctgtctgtttgcttgactagtgattttttttttattttttgcatcatgcgtagtgccttgcacataacaggaagtcaataaatatttgttgaatccatgaatgacttctgtcttaatttacttgaacaaccacaaattcaacatatactatgtgcaaagaagtcactttgctatgttagttatgtgctcctgccctctggaagactgttttccaatagagccagtagcagcccagcttgaagctatcagaaagtcatcttctccttctcctaacttggggaatttccatgctttatttgacaaataataaccagcaaagtgcacatcaataaagagccacttattaaaagaatgagcaatttaaccaaaaatatctcaaaaagagacttctatgttagattttataaccacatgtaaatcacaacagtatatggaaaaacacttagatcattatatttcatttattttgcatagtttatctttccaacaatatggaaaacttctaggaggcaatagtcctaatttcatctctgtattttttaaatgcttagtattagttggacaatttgtaggtattctgtaaacacatgttgactttactgttcagtactgaaaagtaaaataaggatgttctcattacttatgaactcaaatgtgaagaggagtagagaggcttacatttgaacttcaggcaaaatactcagccactttcccaacccccataaaaatatttaaaaaatgacagatgcctcacaaaataagtggtatcctaaataatttactcattggtatagcggcagctcatttcccagaatctgtaatgacatttgtttttttatttaaaggataagaatacagcagtgctcatgttatcactagggtaataattattgttgcaaaaagcagctcctattcttctggttgttttaaattggggattcagaggtgtaggaagaaattatagattattattctttgcttcttaagtgatgcactctttatatacaactgaaataattaatagaaattcaatcttcaagttattgtgacatattttaggaaatcagcagtaattatttcctatctaatttttataatcattagtaatcaggtaagagtttatcttgttttgaaaattaaattttattgagcttataaactacattacaacaaagaaaaataaggcaattttcttattactaaatcaaaaacattatccaattttttttaactggaagttttcttcgatgaatgaatatgcagatggcatatgaatggatgccatcatatgatgaaaggatccatcatgaaaggatggatatgtagacaaacatatgaataagcacctgatatgttttggatctgtgtccccacccaaatcacagcttgaattgtaataatccctacatgtcatgacatggaccctgtggtaggtaactgaatcatgcaggtaggtttttccagggctgatcttgtgatagtgaataagtctcataatatctgatggtttaataaaggggagttcctctgcacatgctccctcttgcctgccgccatgtaagatgtccctttgctcttccttcatcttctaccatgattttgaggcctctccagccatgtggaactgggaatccattaaacctctttctttataaattatgcagtctcgagtatgtcttgattagcagcatgggaacagactaatatagcatttaataatattctcatctgtatgtaacaaaattgaagttatgcacctttccttgattgattgatatgtatatcaatctattcatatatatagatttatatatatatagcttataactttaatttgtcttaataatcatgtatcacctattgttcttgatattgcaccacaaggaacacaagtgtgaaaaagaattctatgagatctaggggttcatattccagcacaatggaggccatatttacagagactaagttaaactccatacattttccacaaacaaaatttaacaatttttaaggaaatattattaaagaacgctgagagcactccaggttgtctatgcttctactcattgaaacaactcactcctccagtagcagatgagttttaatgaaatgcctgggcaatgtgaggaaatgctttttccttatcagatataacccacaacaaatcacaaaagggtactttttaatagtgttttcagggaacgggtctacccctacccttaggctgacaataatgctttaagcttttcctacatacatctgcacacttaagaggaaagaatttggcttataacattttaaaactcattaattaggatgccaccattacaagggttatggcattcagataatgcctaggctgccgtttccatttgagtaaagtaatggtagtaagtgaacatatactgtccaagataataatgaatatgatttgttgggttgttgattatattaaacataaatacaaaactgaataggacctcctaagggagaccctcagttattctgatattgttctactcattcccttaccttggctaatattttttttaaaacaagcaataagaaaaagatgaaagaatcaacaattcctaccacattgagacgtggaatccttggcctatattacttttacactcatggaagatgttgcaacataatggaaggggcatggacttgggccgcaggaaggacttggttcaaattctggtcctgacatttctagtggggttgccctattttttaatcagtaaaattggactaaaacctatctaaggattagtataaatgtgaaataaatgatggatgtaaagagcctaccacagtagttggcatataataggtgttcaaaaattgttaaatgactcttacattgtagctgttacagacgtaaaattcaatggatagaatagaaaccatttacaatgccttgaaaaactcaactacgtcagatttaaaaactgatttgtataatcacgaaaaggaaaagtaggacaatcacattaaatattgtataatcagactttgcaaattcaatctgaatttctttctaattagtcaaaattagtgaggtatggttgttgcatctcttaactactgtaccacagggtccggtcatcacctgcttctatttatgtttgctgttcccgtaaggaatcctcctaggtacaagtcccattaatagaagctggaacattgcctaaatgaaaaattttatgtattccttacttcctgaaggaactgccacggggtcggtcctaatcagcacttcattttaatacagtatcatcgagttctaaggattaattttataaacgattaatgaaagtacttaattgaatgtcactctctgctgccttcagctattacaggttgttgctctcactgattccagatcgatgcttttttaaacactcagctttgcagtactttaaactactttgcagtctctaaacttcatttagagactcacctgtggctcaaataaaacaatctgggatttgagttattgttgttgttgtttttggaatgattgtacaatgcttgaccagcgacagttcatgttgatttcctccaacagttcatgtttgctttcctccatagaaacagaaactcaaccgggcatggtggctcatgcctgtaatcccagcactttgggaggccgatgcgggtgtatcacgaggtcaggagtttgagagcagcctggccaatgtggtgaaaccctgtctctaccaaaaatacaaaaattagctgggtgtggtggcgggcgcctatagtcccagctactcaggaggttgagacaggacaatcacttaaacttgggaggtggaggttgcagtgagccaagaacgcgtcactgaactccagcctgggcgacagagggagactctgtctcataaaaaacaaagaaagaaagaaagaaagaaagaaagaaagaaagaaagaaagaaagaaagaaagaaagaaagaaagaaagaaagaaagaaagaaagaaagaaagaaagaaaggaagaaaggaagaaaggaagaaaggaaggaaggaaggaaggaaggaaggaaggaaggaaggaaggaaggaaggaaggaaggaaggaaggaagggaaattcaattttgggggttgtggcaaacactacagctaagctgcaagttcttgcacccttacaagtggtcatgtggcatggctttcggccaatgaaaagcctgcttaggatttctgcaaaagttttgctgtccttttacaggttttgccccttcctccatattgcttctgttctttcctcctgcccagagcatgaaggaagatacagtgcagcagctatttttgaattaggagaatgaagactaaggagactggaatagaatcaagattaattcagcagttaccataataggcagcagcatggatttggcccatagacattatttgctgacccctactatagacaaatggattaagttcagcccagaatcaagacagaataggaagggaaatgataatacaaactgtgcaactgcagaagaggagaaagggtgcaaaatacattaagaacacctgtgtccacagctcactcagtgacggaacatcaagtaccaaggatatgtacaagttccagacagtggttaaagcacacttcctcaggttaagataagttcaggaagtggaaaagttcacactacagctgagataattcagttttgagataacaggatgagttggagctgaaactaatggaatgtgccataaaattgtatagaaatcaatcttagttttttttatcttctttttcttcaaagagggtttgttataataaaatattctcagacctccttctatccttgttatactttttaagacaccctggatggtagtaaatccttggattccatttcaggatataagcagaaagagatgggaagagaccatgaaatctctcaagagagaatgtcaagagaggcattatcatcattatggtctctcttgcatgatctcaggtattatgagataaaatacaagtgtactattgctttgtgaatctgaggctatctggcctttcttaacatgaaatacatcatggcatgtcttgaaaacttaagctttgatcatgttcagtgaatagagaggattgaacgtttgatcaatctaatgaattgaaacacagttcgcgaggaactctgaagacttttcattctgtcatcattccactatgtggtaaataatagctagcacatattgatcacttattaggcatcaggcactttgtagtgcgctgtatacagtctacaattgagcgcatctaatcttccaaacagcagtataaggtgtcatgaccatgctaacttttcagacagtcttatagggaaagggcaagtttcttaacctcaatttgtatgaagcactaagatatttcaatgaatattccggatcaaatgtgtttctccttataatttttggtggcaaaaaaaatctgctgtcaaatacataatgtacttttgtttcctaggttatacagctctagctacagtcttgagccctacacaaccctgaaactgggagtaaacaaatgtcacaaacatgactgtattattctttaaaacattttatttacaattcagtttggtgagtagttgtctttaaagtttttattctttaaatatttgcttttctttctattttataatatatcaatacttaggaaaatacagtctgaataaatgtgtataacttttcaaaataatttttaagataccagcaaaaatttggtaaaaattgggcaaataattgttgatataatatattaatgcacaaggaaggcaacgcatagaccatgagagctctcagctctttgtaaatgtcttaaaagctacataggactcattgtttaagctaattctatatcattggataaggagttatcaaaagcttccaagtaccacaataaaataagtatattaatttatttgtttattcattcagtaaatatttattgataatttttaaggatcagactaaacaagatggaccaagtcctggctttctcagcacttgcacatcaacagacagctgtgtccacaatcagtaagttgaggatggcaggacagatcaccagagcataagcaaaggtatgagctacactcacagctaagacactgaactatctgccctgggtctaagcaaaggccacagggttggttttccagaagctccaagataggtgcatgtatatccagatccaatgttcacagcttggaactgtaatctttaaaagctaagttgagggctcaagtcaaaacatttctctcccaataaaaatcatgactacttgcagaaggaaaagcctggctatttggtttttagggagtcaggagcactaacctgctctttcagcttgcaagcttgcaattctaggcttccaagtgaaaaccaacctgcttatcttgcctcatctagaattagaggggtgacagaggaaattgggaagtagttttgaaagctgcagtgccttccttcctttccttctttctctctctctcttttcttccttccttccttcctccctccctcccttcccctccccctccctccctccctccctcccttccttccttcctttttctttctttcttgacagtctctctctgttgcccaggctggagtgcagtggcacagtcacagctcactgcaacctccacctcctgggtttaaacaattctcctgcctcaacctcctgagtagctggtattacaggtgctggccaccatgcctggctaatttttgtattttttagtagagatggggttttgccatgttggccaggctggtctggaactcctgacctcaaatgacccaaccacctgggcctcccaaagtgctgggattacaggcgtgagccaccgcacccggcctaaagctgcagtttctttaacttgttatttactataatgtcaggaaagggcaagaatcttgaatctgaaataataatgatgacaatggggttgaaaaaaagtaaaaagttattgcctggaggtaagattattttttttaacctagtattttaaatatattattttattctactttaggtgttaaatacatgaagtagttaattgtcagcaataatataatgtaaagtcaaagtacaagaaagtcttatgctttcaagccttgatgtaaaaaataattatatgaagtaagttaggaatgaggtgggtaggaaattgagggtgccttgctattttcagcaactgtcagagtgttcggtgcatgatacatattttctgaatattttcagaaaatcatttctgatgtgtcagtatactttgagtcttggaacacttaactgcaaaacgaagtcgctgtgatagagaaaaaggaatatgtatatataaatgcagagatataatgagatagatgcacatttacattttgaaaatcaggttttcttcactgcaaaaatatgtggggttcttctgaggttaataattattacataagaccaatgataaaactgcatttctttgttatgaagcctaagatattaggtgtgttttcatgcaattgcattttaaaaacaattcttgcaatcatcttattttgtagtgatgttcatgaacatacttaataatagatacattttttattacaacaaaatactactttaataaaaacaccaagttatttcgaaatgcacaggaaaagtttctctccattgttgtgcatgctgaaagaccacagtgggaagcacacaggcagagggaaatctcagaaatatgaactgtaacaccacacatagcagcattctggtctcacaagtcagtagatactttccccactaaaattttgtttcaataattaatataagcttttttcatctgaagtatctctaaatcagagaaggttaaaatcaatctgtatgtatgaacttgctgacaagctagtgtagccacttgcctttaggtttttattattttcccagtggctgatgggcaggcagcagtgttaagcctgctaactgaaacatattctaaattatatggatctctggaggggatgcattctacttaaccttggcgtttgttttaaattacaggaatctaccatattatattatccaagatttttaaaaatagcttttattccttttctaaattgcatctcaaggttgttagatttcctattaaaagctaattaattaaagagaaaatacatacatatgtgtgagtgtgtatatatatgtatatatacatatgtatatatatactcttctacacctgccagccagaaccaacaataatattgtcccaagctatatagtacctgcttccaaagaagtttaaaatccattttagagagccaattattgatgtttaaagtctgtaaatcatgaaggtagcaatacttctaagtatcaaaataaaagctatgaaatgccatatcatgaatatatgctctctcacttaaactgttagaattttcattttttaaataaattttattgtatgtatttcaggtatacaacacgatgctattcctgctctgtttgctattcaaaatctcccccttttgaaataatatcactaaaaggactaaaagcaaattgtttgcttaatgggttgactgatttttaaagactaaaagagtcaaatatagatgacaccaaaatgtggtccagaaccaatagcttgtctagcctgaagaccggatgaattattttaccccattttagaccatttccatctgttatttccaacacaaattaaataagtcacaagaaggtatcatgatcaaggatacctttctggagaatagccatgttgattttaaactaacagaaatttatttgtggggtaagtatggatacttaataaggaaaaacagaaaaaaacttttaatagtcccttatttatttcaggtactgtgttagctaggtattttacttattccttctcagcgaatactataaaacccatttattaagaaattgaggctagacgatgtaaaagaaatgaatctggaccaattcctgcaaatcatgttaggaagttacaagaaagtaaaaagattcatagtcaatcaagtgctgtgaatagccattgagctctggaaagccatagaagcagacacattagatacaggatagatggttcctgtagaaagctttacagaaactgaaaaagcctaaagctacttaaatgatggtaacagtagggtagagtagtacttaaccatatgacctttggctagactactgtatttgaattacggctctgtcacacactaaatatatgattattgataagttattcaccatctcagtgcctcagtttccttctttataaaattgcaataggacctactgtataaaacctgtgataatttggtgtcaaatgcacataaaacatagcatagcaatgtgtataaagtacacatatatcaaatgttagctctaattatttctgtgaagacaaatatattgcttgtggaacacatggggagatcgatgttgtctttacagacactgcagtgcactagaagagcatatcagtaatatcttgttctttaaataaattactagcattcatatggtatttatcctgaacagggaatatgataaagacttttatggattttattttcatttaattttaatgggattttgatgaatgtactattcccattttgcaggtgaggaaataaaggtaaagtgaatcttaagaagttgcttgagtccatagctgtagtgatagtgcccatattgaaaaccaaatcatctgataagtccagttcctgaccactacattatggtgcctttctaagggataatgtgacacaggtatagaatggtgacaattgtagccataagtgccctttccattttcagccctccagtgcttcatgaagtactgtgttcatgaggggctgctgaatgactgcctgtaggacacatcttcccagagcacacaccctggcagatcacagcccaggagaaccacgagcccatctgaaacctcagaaatagcccagtgcctgcaggggatggtgctgcagcttcagacaggacctccatgaggggcagaagtttggtgaagtatccctgatcacagtcagcttcacatcgtagggctttgaaacatgatgctgtcaattcatcttgaattgttcaaggtcaaactcaggcattcaatgctgtatcgttcctctccactcaattccatccctttccattccatctcattccattttttccattcgctccactgtattccattccattccactccactctactccattctgcgcaaacttattaactacttactacactacttagtctgtaagcaaaaagcagctgctgctctaaagatgaataaaattaggcttaacacaggcttaaattaggcttaaatcaggctgaccaagttccattcagtaggcaagtttaaagagccaaaatctataattttaatacttttagctctaaagctagaattggacacagtgttcttccaatgtatagaaaagtctactcagaaggctttatttttgaggacttggagagagttaaataaggtattttcgacatatgttttcaatgaagcatgaaaactagaaaggtgtgtttcactggctgaggatacttcccggtaagactcaaggtctaccatctcaaattagagttctctcaaaggtgctaaactctactgatttttttatgaatcgcatgtttctatattttttttgccaaactctcccttctgtaaagaaccatgatttaagctagcaacgacaaatgaagcatagttaccctcatttgatttgcggcatttcagactcaactatttttctgaaacatctattttatttcaatagagacaagaagcctgctagtttccttaatcctgcgttttaaaaacatacttctatatgaattggagaaatgaaatgtgctccatagtttatgttattccttacttttggaatgtatcctaatctcaggattcttcattactctgactacatattatatttatttccatcctaaggtttttcaaagataggcatgtggattatctagatcaacaatccctaaagggcttttaaaatgtcaattcctgggccctactccattcctgaaaatcaaaattttgaagcagaaatctgagtctccaaatcatctcccttggtatatctcaccttctatctccctttgcaatcacaagacagtgaccaggtccagtgatgatatcatgggctgtctgtcacctgcctgacagtgattcctggagactctcacccaaacaaactctcacagaaactaggcaacgtaagagacaggaaggttcagctggggaggcttcattgcgtcaggaatgccttatataattccagaaggtcaacaagagaaaaccaggccaacagagcataaatgtcaacatttatgggcccagctggtgtcctgctgaggctacgtatttgagattttgcaagccaggcaatattgcaagttaacatgctgtatagattctgattctgcaggaaaattctccttcagtgttgcatagttgcatttactaattctgctttcttagtattttgtgtatttgttttactttgtattttaagtttcagctaaacaaatgacaagtaaccaaaatacgaatgaaaggactatttcctatgcagctactgtgtttacatatattacctcatttaatatggttaacacgtcagggcacggtggctcaagcctgtaatctcagcactttgggaggccaaggcaggcagatcgcttgaggccaggacttcgagaacagtctggccaacattgcaaaaccctgtctttactaaaaatacaaaaaatatagctgggtgtggtggtgcgtatctgtaatctcagctactcagaaggctgagaaatgagaatcgcttgaactcaggaaacaagggttgcagtgagccgagatcacgccactgcactccagcctggctgacaggatgagactctgtttcaaaaaaaaaaaaagtaacactttgagaataggttcttattatctctatattaaaaaataaagcaaacaaaacgaacagtggataattacttacccaaagttaataaatcttagcattggatcttgagccctgtttctttcaaagccaaaatctatattttattctattacactctgctgtttccaaaacaggccaaataatttctacccctcaaacatttaccagtggcagaaaacaactatgaaatcacactgaggccataaagtaataagaggaaatttctataaagccacacaaccatctcatttccctgtggccacactttacattcattcaatgaagaatcaggatctacactgcaccacacattgggggctgaataagcacagacatacctggtaatctttgatttctcagactctacaggagatcaaggttctggcaaatgtagaagtacctcaaacctttctggtcattttcaaacttaaattctgtatacagtacaagcatactgttgagggtggctttaatgtgtaaaactgctgcttatggatagtggcgatgggtgatgttgccacacctcatcactgcatgccatttaataccttttatccattaaagttcaggccaccacatcagcactacaatattttaaatccttatatctgaaagtacaggaacctctccacttttctgtgtgtataatgtagcccttggcacattgcggaaaacaaaaacaaagaaaaaatacaaaaaaatatcaccatctgtactgggttgaatagtgttccttaaaatttcgtgtctacttggaatttgtgaatataaccttatttggaaatagagtctttgcaaatataatcaagtcaagattaagtcatactgtattagagagggccctgaacccaatctgacttgtgtccttatcatccttacaagaagagggaaattgacctggcgcagtagctcacgcctgtaatccctgaactttgggaggccaaggcggccggatcacgaggtcaggagatcgagaccatcctggtcaacatgatgaaaccccatctctactaaaaatacaagaattagctgggcttggtggcacatgcctgtaatcccagctactcgggaggctgagtcagaagaatagcttgaaccagggaggcggaggttgaagtaagccgagattgcaccactgtactccagcctaggtgacagagtgagattccgtctcaaaaaaaaaaaaaaaaaaaaaaaaaaaagacaagggaaatttggagatggagatacagataatgaaaagaagggcatgaacagatggaggcagagattggagcgatgcatttataagcctaagaatgctaaggattaccaccaaccatcagaagctagaagagataagaaaggagacttctacagcatgtttagaagtagtatgtcccaccaacaccttgatcttagacttctagtctccagaagtgtcagatagtaaatttctattgttttaaaccacacagtttgtgatactttgttatggtcaccctaggaaactaacacaccatccataaatatccatgtaccacatgcaaggtgctatgctcagcgttgagaatatggaacaatggagaggtatacctggaatctgggacacgtatcagtgtctatagacatagaggaggaaggtaaaagagtgttccacttcattttaactccagtgtgttgcttcttttctaaggagccacagacaatgacttctcatcctcctcttcctcattattccttggcttacaagctaatgcatacatcatggggttcccagtatttccttttccccccaatattttatgccccatgcttgtgtttatattgtgatataataaaatggcacgaagtagaaacacacccttcacatggagcacacattacccagtggttttattaagacttgtgtttcggcatctgagctatgtgaaatctcactcaaggctctgtaatgccggtatgttctctatatgaatgtggcacgactgaaaacataaaactgttatcacaaaactgttacatacattgtaaaacaaacagctctctgatgtggtttggctctgtgtccccacccaaatctcatctcaaattgtaatccctgtgtgtcaagggagagacctggtgggaagtgactggatcgtaggagtggattctccatgctgttctcctgacggtgaatgacttctcacaagatctgatggcttaaaagtggcagtttcccctttgctctctctcgctcctgccgccttgtgaagcaaggacttgcttctccttctgccatgattgtaagtttcctgaggcctctccagccatgcagaactgtgagtcaattaaatctcttttatttataaattacccagtctcaggcaattctttataacgtgtgaaaatgaactaatacactctcaaaatccatccaatgcataaaagcaccatttgaactgccacaaatgcaataaggcctctgaagttttctagttccaccctttccatcacctcagctaaagtatcttctcctaaactccaggacctccttttgtaagagtgagaattcctaaattaaaataaccaacagaaagtgccaaagaaggaagggagaaagggagggtgggatggaaacaaaattgatgagtgcagttgtaagtttcagggattctttacattcctaacattggtttatttggtattataaattaagaaaatttaaaaattatccataatgcccaatgactttgtttacagatttgtatcagatcttacaggaaatggatcactgaaatagtcatgtccagattgagctgacatttactgagttccccttccacttcaaactcagtgtcagataccattttatatgctgtgtaagaattcttttgtgaggccgggcacagtggctcacgtttgtaatcccagcactttgggaggcccaggcaggcggatcccgaggtcaggagtataagaccagcctggccaacacagtgaaaccccgtttctactaaaagtacacaaattagctgggcatggtggcgggcacctgtaatcccagctactcggaaggctgaagcaggagaatcgcttgaaccgggaggtggcagttgcagtgagctgagattgtgccattgcactccagcttgggcaacagagctagactccttctcaaaaacaaacaaacaaacagacaaaaaaaaaaaaaaagaattattttgtgcttatttacacaagctcaaataggagtgaacaaagttttattagcttgtatgtagtcacgcattattataaccaatattaatactgggtcttaaacttaattaggccttcagatttgaaaatctcaatatttctttctactaaaccatgtggcctcaccaaatatatttctgtatgaatcctagagcacatgttatcttgggaggagtctgttttttgcttttacaaaacagtcatattgccaaatatttaaaagaagaagttctacaatttatagtatacggtcacactgtcacctgacaacctttaataacaaaaatagacaaccttacatgtacatagataacatttcagcaacagttttctaacagtgagccacagctaaaattgtgagcatgggtacttcagcatgaaggctcaaatcaggagaatacgtacaagagagaggctcatgagaatttaaccttaccttgcatttcccctaaaaacaatggctctggattcaccaattcagtgttcaagatgactttataaaatataactaccctaaataatgatgattcactgtactttatcttactcttaaacatgtacaaattttagtagcttatgaaaggatcaaggtaactcctgtagaaagaaaaactagtttaatcttgtttgatccattatttaccaaacgtttttgactacagatctaacttataaagaatacatattatcacctcacaggacaggaatgcattgtttggaggccctgctgtaggtgttcagaggttttttcagtccttcttttgaggccacatgatctattatttagagtgttttaaagcatcactcatgaccataaatcaagagatgaggcctggcacggtggctcacgcctgtaatcccagcactttgggaggccgaggtgggtggatcacctgaggtcaggggtttgagaccagcctgtccaacatggtgaaacatcatctctactaaaaatacaaaaatttgccaggcatggtggcgcatgcctgtaatcccagctacttgggaggctgaggtgggagaattgcttgaatccaggagacagaggttgcagctggccgagactgtgccattgcactccagcctgagcaacagagtgagactccatcacaaaagaaaacaaaaaaaaaaaaaaaaagagagagagagagagatgaaaaaattacagagatcctaagacatctctcatccacttggctatcaatatcaacctgagttggtactgcagtctgataaaattcccaacttgttctttgattagtagtgcttcagccttatcccaatttattgacattcctatgctgataaacctactcttacccttttcctttccctgagggaatgtttattctagtcttaaacttgagccaggcagtcaggctctgggagtgagtggagagttcactgtataaaagaatgtcaaaggtaacctttaaggaacgctgtgccacctccagagtcagatttatagtgaagttaacgaagcttaggcttcagacccctccactgcacagtccagtatcctacccaataaattctagcaaaatgttcaagtcatatagtcttataagctttctatttatttcttttcttttcttttcaagacagggtctcactctgtcacccacactggagtgcagtggcataatcaccctcactgtagctttgacttcctgggctcaagtgatcctcctgtataagcctcctgggtagctaggaacacaggcacctgccaccaggctcagctacttttaaaatttttttgtagagatggagtctccttatgttgctcaggctcatcttcaactcctgggctcaagcaatcctccaacctcagcctccaaaaatgctaggattacaggcatgagccaccaagccccgcctaattttctaatatttagaaagtaagatagtttaactataattagttaatactgctccttttctgctacaagttttctatggcacgctttctttcatatcttttagacttgaaggcaactgtggacatttttagaatgcagctaagtaagagaacatgtagttttatttatgggttcatagctttttatgtacagtcaggttatggatgagtgtcctagggtaggaatggcttccacagatgtgtctaccacccaatgtgccaactcatctagtgtcataattcaaaggcgacccaaaagtgaaatgagcatcactggaagtccccaactctggaagaacaggaatagtggatggactgctcatttcaaagtcagttaagcctaataacttagagtcaaaaatattttaaggcttcaaaaatatatttttaaagacttgaaaaaataactcaaataaaatcgagcttgaaaatattcaaaagcttgagaaagctcaaatatatcattttaattacaatttataaacatgttttaaaatttcaataaaatagcgaaaaatataaagctcttgattaggacgttatgaaattacctttattgatatttataaagcaagttattaaagaagtgtggtagaatttagattaaagtaataatacaatgtaaaacaaaagtgatcaaaataaaaagtgaaattgtgaacttacgaattacgttgcatgaagaagaaagttgtaatagcatcaaatatatataaaaatatatatataaatatatggaacacaccaaaagaaacaatcattagtacaagagagagaaatttttacaagaagtaatgaagaagctcttggattcagaatagtgaatctaagtaacaaagaggaataaataatgaatcaaataattacattaaaaattaatttcatgttgaaatgaaacaaagtactaacatttattaaaataacaaaatgcaatacaccaccaaaatgagactatcagaagtaaactgttcaatgaatactgtcaattcaatgatgattttaaattaatgtacaacaaagcttaaaatgtcatgaaatattacaacttacgttactaaaggaaatcaatagacattcccaaatttgacaacaatcctaaaaatgtatataatattacaaataatgaattatgaagtaaaataaagctttcctattgacaataaaaaataaatgtttatcaactctgtgataagcctgaattatttttctatcttctatactaaaagtagtgcaaaatcattcaactttatgcaagcaagaaccaggaaaactatcacacagatctataaggcagctattttattttagaatgttactcttttaattttttcatatgtatatcatttgtcagttttctaaaaactgtaatttcaaaattgatcattcctaatcctaactattcatttttacacttagttttatattttaagcatgtatttttttttcataagagaatcctaaaactgtgtaatctctggaccccatgaaacctaaatttgctctacaatagaggtattagatgatgtaagtaaacttcaaagccaattcaaaaacagggacctaatactgtttatgttgtttgctttgttgtagctaatatgtcagctgtgaaaataagtaattcaaaatttaagctgctggaactttaaaatattttgagcttaaagggaatgtgaactaaatctcataagcagacagttgtaaagtcagcaggtgtaacctttgtttctccgattacagattagccttttccttacctacattgtcttgtaaaatgttgcaaatgactaaagggtgccagggaagaagacctttttccttttaagtgttgattttcattatagattaccttccatctttcttctctcacacatacttcatgactaccgcattgtctacgatggaatgttaaatatactcttaaattggaaaggaaataaaaataacctttatggataagaaaacgaaccataatttattaaattgttgtgactcctaaactagccttgtacaaaaaatgttataatactgttaaattgatttattttctgcctatataagcaagaccttaacttttaacatctgagtactgatcccatttctctggagttcatattttccggatggtctttcccagctttttgcatgaataaactcttcaaacctggattctggtcctttcaattatttcaggctgacatagcattgaaaaatagagtaccactgacctagagtcagcctatgagaaattctctctctgtctctttctctctctctctctctctctcacacacacacacaaacacatacataaaaaatttaagacattgtattaactttatagctccacataacaaattaccaaaaattgagtagtttaaaataagtatctatttattatctcacagttctgtaggttggacgtctggacacacttgactgggttctctgctgagaatctcacaggctgaaatccaagtatagctggctgggctcttatctggaagttccaaggactaatccactttcatgctcattctggttgttggcagaagccaattccttgacattgtaggtctgaggtcacaattgcattgctagctgtcaaaccgggtgctgctctctgcaaccagaggctgccctgcattccttctcacacagagcctccatcttcaaaccttcaagtgcatcaagtcctttgcaaaacccttagttctgggaattgcccacccttttcctggaaaactcatgaataattcacctcttgtttaatgtgtaatcaagaatcataaaaatgggcaaccagcagctgttggggctgttctgcccatggagtagccattcttttattcctttactttcataataaacttgcttcaaatctttctggcttgttcttctgccactggttggagaaagctttatacttttaagttgtcggaggcatttgaactagaacgactccatcttgaataggggctgggtaaaataaggctgagatctgctgggctgcattcccaggaggttaggcattctaagtcacaggatgaaataggaggtcagcacaagatatacatcaaaacccaccaaaagcaagatagcaaggagagtgacctctggtcgtcctcactgctcattatacgctaattataatggattagcatgttaaaagacactcccatgacagtttacaaatgtcatgacaatgtcaggaagttaccctacatggtctaaaaaggggaggaacactcagttctgggaattaaccacccctttcctggaaaactcattaataatccaccccttggataacatgtaatcaagaaccataaaaaagggcaatcagcagccctcggggctgctctgcccatggagtagccattcttttattcctttactttctttttttattattattacactttaagttctgggttacatgtgcagaacgtgcagttttattacatggctatacacgtgccatggtggtttgctgcacccatcaacctgtcacctacattaggtatttgtcctaatgctctccctcccctagcccccaaacccacgacaggcccggtgagagatattcccctccctgtgtccatgtgttctcattgttcaactcccacttatgagggagaacacgtagtgtttggttttctgttcctgtgttagtttgctgagaatgatggtttccagcttcatccatatccctgcaaaggacatgaactcatccttttttatggctgcatagtattccatggtgtatatgtgcccattttctttattcagtctatcactgatggacatttgggttggttccaagtctttgctattgtgaatagtgctgcaataaacatacgtgtgcgtgtgtctttatggtagaatgatttataatctctaaggtatatacccagtaatgggattgctgggtcaaatggtatttctagttctagatccttcaggaattgccacactgtcttccacaatggttgaactaatgtacactcccaccaacacttgctttcactttactctatggacttgccttgaattctttcttatgcgagacctaagaaccctttattggggttttgatcaggatctcttcttggataataaaggaattataggactagatttaatcacaagattagattagacccactcacataattttgctatttgaaggtcaatcattggggacctataatcatagcaatgacatttcaccatattcttaggttctacccacaattattttgcaagggtgaggggttattgggggccattcttagaattcttagaattctcacagactttctatcaggattacaagatttatattgaatgggtagtctaaactaaggaaaagcaaaaagttgactcttcacagggagtttgagccctagttcatataaagcaaagaaaataaatcagagatagcaagagaccaagacagatagatgtaattcgaagagagagaaacagaaactaacttgccatgaaccgaaagattgtatattctttttcctctctgattcactaatgtatgctttctaggagaagacataacatattctaaaatgtttgtttttcttaaaaggtatttgcatttcctaattggcatattatttcataattatactcatactaaatctgaatgtttgagccattcttatgtcttccttccatgataagttgtttatgttgtggaatgtctgagtctataattaaattattgtctctaacaagttaaccatatccatgcatacattaacatatcattataatgtgggaaaacatagatgtgtaccatagaacatcaagctgaatggggctctgcagatctgggttgacgtttctggtaactggtctccattctggaggtttcaaggggcagaactaaaaactccagaagaaagagaaaatttattcttatctgaaataaagagaaggtatgataataggaaatgttattttacaaatatctactccaatttctcttcctttctaccacggaaaaaaatatttcctcatcacattcatattgctgggtttggcttggctcttgtgctgtggtgatccactgtgatcaaaccatgcccctgagactgggcactaggacaaatgaatgtggagtagaaatgccaaaatctgctgttcaactgagtctcccagcagaacccagtctagatcagctgaaccaagtcacatacagacctgtgaatctgaagataaatacttggaattgcaagcccactgtgttttgggacagtttgttacacagcattgatgcagccatagctgactaatacaacaaagaaaagaaggaaaaaatcttcagatacagaattatgtttaaatttaattaaactaaatatatacatatttatgtctgtacatttatagattatatctatatatatgacacatgcactttttaaaaatagctcctttggcagagttttgtgttaatattttcattaaaagaggctcttatatgataatattgctcacaatgaaatgtaacaactgtgtagctggaagcattatctctcctctttgggcaacagtccctgtagtctcttggttattcagaattttaaagggaccatattaccctataaacttaagcatatgcacaaaactgcttttggggaaggctacgatttctaaacaatctcagatacataaggccgaatgtctgttatctgaaacgcttgagactacaagtgttttagatttcagattttttttggattttggaatatttgcatacgtatttgcagatagaagctattttatagcttggggatgagttccaagcctaaatctaaaatttgtttatgtttcatatataccttatacgtatagcctgaaggtgactttataaaatattttaataattttgcgcctgaaacaaagtttgtgtacactgaaccatcagaaagcaaaggtgtcccaatctcaaccacccatgtggacaatctgtggttgtttggcatcattatcattcctgactctgaatttatatgctattaataagcatttattttcttacatttattcacacataagtacttaacagtaaaatatatggcatattgttaatgcagtgaaaacataatatgttcagggtaaccaaggagcacagcagtgtcaccagaatacctgttatctgtttaaaaacaccagcaatcaaaaatggcaagtcttcacttattcaaaaatgtttatattctgcagcatttcggatcttaagttttcagattatggatattcaacttgtagtacatttaattttgtgatttcttttgttaaataaaaagaaaaatccttgcagattatatgaaggtcagaactgtctctttgcatcaataaaacatcaaaagaaaaagaggaccactgggatgggaagaacacttccaatgcactactgaaaacaatgtaaatggttgggaaagttggccacaaagtcttctatttcaatagttgtaataacacatcactgttgcatataaaatgtatctgcaaatatgtctataatgactgctgatcataagatttcttgttctattcactctgaagtctaaaaaaaaaaagcaaactatctacataatccaattgaatactcattacataaagtgctaataatgtataccttctcatatacaaaaaaaaaatggatggtttaaaattgcttagatcacaagagccaattacttgggcagaatggggaaggtgatatgaatgcataaatcttacatatatgccttaccatggagggatagcttatatgcatgtggttgaaatgaggaaaccctctctcacctataaattataatttaagcattctgtaaaaatttaaattcatacttaagattcaaattattttttccatacagagcagggtttctcaattgccacactactgatatttgggactgggtaattcttcactgtggggaatgacatactcatgataagatgcttagaagaatctctggcctccacctactagatgctagaagcagtcccctagtctggagttgggactatcaaaaatggagaccaggccaaatgtcccctggggccaaaagcactcctagttgagaagcaatggtctctagaaataccatgcagtacattccttcttccaataatagatgctaatcacaagcacacaagatagccacaattatatgatgtttactacttgccagacacatagtagctcattttaattttcacaaaagtcaaatgacctatataccataactacctgatacaatttggatgcttgtcccctccaaatctcatgttgaaatgtgatcccccatggtgaatgtggggcctggtgggaggggttttggtcatggggtggatccctcacgaatggctcaataacctccccatagtaatgagtgaattctcactctattacttactgtgacatctggttgtttaaaagagcctgacatttctcttgctccctctctcatcatatgacatgcctgctccccctttgctttaaataaaagcttccttaggcctcactagaagccaagcagatgctggtaccatgtctcccatacagcctgcagaactgtgacccaactaaacatttttattttttaaaataaattacccagccccagcaattcctttataacaatccaaaatgggctaatacactacttctatgttactaatgatgagactgagtcatagagaagtgacttgttcagacagtaaagggagcctggatttgaaaaagggcagtggggcatagaaggataaagtcctaaatgagattaactttgggacaattggattccagagagactggatacatgggtagtatatcctatagaaccctctgctcacatgttaaatctgggagctgagctagatttcagaagtcccttccactactaacaatctgtaagtctgtaaattgtagacaaatctatttggttagatttattccaataaaagcaagctgaccacatgtcagataaggtccagctacagcataatggcatgatggcagccttccatcttcactgatttaaattcgtgctgttttagtgcatataacccccttagatttgtctgctatgagaaaattctgcaaggaagagaaggctgcttacaaaacagtctttcaaatttctccatggatctcattggcaggtcttcaaggtcaggaccaatcacagacatggctggagaatgcccataaactcttcctcctctaatagccaatgggagaaagggattaactgctggtcagatgactgtgactattaacattggaagcaattctgtgcttgaaaacttgatcagtcaaagagggtaaactacattaataatgggcactggaaggagggagctctttttcaccgaagtccccatggtcacaacaaattagattagagtgcctgagaatatgctaaattcatagcctcatcgaaaatttctctttagtactttatctgtcgctagtctctcttctcttgcaatgggtcatttcagctgctgctaaaaccagctttctattacagtttctcctcatgtcatacaattccttaaaggctgatagcatcatcggtccctgattcttgtccatttaacctccctacccatagatacaatccaagactggtactcataaattccaaaggaaaaataaagctgcatattgctacctctatgacaggttacttttggggaatagaagattccaggacagctatttcctgtgtttattgattatgaatcttgaagaaagaaattttgtgtgagcataacatatacataaattttaaaatttcaaaaaaaccacagttctcaatcttttgaatctgccaaagccagcatgacacagtgccatgcctaatttcagagagtacctcctctctccccttccgtagtcagttgtattatcatcctttaaaacgctttagagggtcacttacggtcactcatggcatattcagatagtttgtaatccaattacattcttgaagatttaaagaaccagaaacaaacaaaaacatgcaaacatgagctacagtttttattgtatgtgtctatatataagagagaaaaatggagatagacgtagatatatgtgaataaattgctgcatataaaaacattagttaatataaaaaacagaaaataaatatctttttacttctttattttaaatgctaaaaacttccttataagggcatcattatatttggaaaacatataaacccatttagattattcaaaaggaatacagtgatacaaataataaaactgacaagatatctaattggaattcttttggttctttcagtttacagtgataaattttaccacactgaataactgtaatttctacctgtgccaaatctatagccagtctcatatcttcttgccactacaatactagaaactttccctgatgaattattaaatgatctttgaagttgctacagttcatagaaatgtgacagtccaatgtgtcttagtgctgtgaactgttaccaaaaagactaaacatccttgacagcctgataaaaaattaattattctccttccaatggaaagaatgcaactctgccaaaacctgttaaatgtggagcttttagagttctcaatttcttctctcttggagagggcacattataatttttcatgaggattaaatagcacatgtgaaatatctaaccttgcctagtatccactggatctttagaccttagttccttttcctaccttagaatttttgttcccctaaccgcactatactaaatgccaatgcatattagaatagaggtggcagtgcaaaatagaagaataaaagaaatattgtattattgcgagaaaggataccagtgaagagatgtttacttcagatacagtaaaatattcaaatactccaagcaagtttttccccagtgagcctctgtttctgcctatgtagacatcattcgacctgtccagttatatctaggttattgtgaagattgaaaaaacaagggagagctttttttaaaaaaaaaaaaaacaaaaaacaacaacaaaaaaaaacctttgtgttacaatatatagatcttattttcaacagcgattaggtaatggaattagtgcagtaaagttttattaatgaatgctgtaattagaaaatgttaattcaatatttgcttccccaggttacattcatttggaaaaaaatgcattaatcttaccatttagtgataactctttcagttcaacctacagacacaagatcttgaaatgaaactgttgattaatttatttactcagtaaagatgctactggatacaatagaaatacaagtcataaatgttttgcaaacaatgatagtaatgaaagatattagtctttttccttagaaattaacttagtggattgagacagtttaccagtcttgccttacaagaactattttaagcacctaaaaagtaatcatcccaagagaaaatatagagtgcaaagagcactttgctatttcctcctgttattacaaagcataataaatccctactctggactatttcttgcctgtatcctgattagatatacccataaagtttgaaaatgtctgcaactgagaatacttttatttataaagcgggatagaggttgaggaggatgtagagaacagattgttatctgtacttgtcacagcaaagcatatttttttaatacttagttttttaggcttctgttggcagattgacctttcttgagagtagcttatcttgctgtagagcaatattcccagacctcctggggttcacaaagttaagaagaaggagcatcaggaaataaagaagacaagaaagcaaaacagaaaagtaaaataaaatttctgctgagttaaagtagggtgtaaaagagccatggaaattccaaaggttgttttagaacctcctatttcacatcctactcagctgtccagaagagaaagcagcaaaaacactcagactcttggggaaacaagcattaggtggtggccagtgggggttgaggggggagtctctcttaaaagggtgaagaaagcacagatgaaaagggccaggcaatgcagactagttgtaaaagcctagaaaataacatctgaaagcttaaaggggggggtcataaaagagttggaataacaagttgtgagcacagatcagtgtagtctgagagttgtttattgcagaaagatcagaaacgttcaagtgaaccatagcaaacttcaaactgccattcacttctctcactaggtttgtgttaatctccgttccgtaaattgaaatcaatgacagcagcctggcagaggcgttgagagaattgaatgtgataatatgtataaaaataccggctgtaataattgcatatcttacactcccgatggaggtccacttcttttttctactactaatgccaatgctagaggcatagataaataagaagcatggagactgagatgggcctcacctgtctggaagccttttaagacgcacttttctggaagccttttaaaatgcacttgtcctacctgagattctccattctgcttggtgaggcaccctgatgaggcatttcacatgtgatcacaggagatgtcaccaggattattctgagttttaatttagtcggttgtaaatggggtcatgataattcatcatcttatgtggttgttagcatagttaaaggataaaatgaaacaaagttctttgtgtgtaaatattagctattgttattattacccccattgttagcataaatcaagagagtgtctgttctccacctttcccttctttaatggagacactggtcactagatttaggacttaccccaaaatgattttgtcctgaaatccttaccttaattatacctaaaaagttcatttttccaaatcaccttcacaggttttctcaggcttaagagagtgacatatctttcagtggggaaggggcacaattcaacccactatggggagttagaagttaagcatgtaaatggacatacattattatgtaatgccaagtagtgataaatgctctaaagtaaaaataaagccatataaggggataagggtgagtggaggatgctctttggagacagcagtcagtaaaggcctcctgaagaggtgacatctgagctaagatgtgactgagagagtgagacatgcaatatgggggacatgtgttagaggcagaaggagcagcaaatgcagagagctgagccaggaaagtcaagaaaaatcagagtggctggtggcacagcaagtgagcaggccagcagcagggaaagagagcagggggctgtgcttgtcacaagaggattttgcattttattctaggtttgatggggagccaagactgggctaagaacagcagagtcatattcaatttctaaggcagacattctattttaaaccaaactccagacgtggagctaaagatttaagtggtattataatatcctcgaataattgctctgataatgagaaaacaccaagagcaattctttgccaatattagaactaaattcagtttgtcctaccatgtcttttcattatcttgtgcttcactgaacatgtcacgagtttgcagaaacaattccttctgcctgcatgcccttccccagtgtgccccctcactctgctgtggcttgtccctggtttgtgtcacgtcccccagataaggtcactcacacttcctccatgctccaaggcgcttattgccctgggtgcctactttctcctatcattaccatctgtttacaagccttcctccttttctgactgtacagttctttatggtcacatgtaaatcttattaatcttcatattaccagaaactagcacactgcacactaggtactgaataaatgttaaatgaatgagtgaatcttggtcctattcaattttattttgcctgggtttatatattctccatcccactatttaaataaacatagacttttttcttctgttatttaatgaatagcctatagaaaggcattacattagcatcaggacacaatgaccatctaaacattttttaacagttcactagaactgtacacagttattagcctgttctttgcttgcaaatgcctcaagaagcgaaatagtggtacgtcctttcccctgtgttaaatttgagatcacagaggcagggcaagctgcattaacctgtctgaggtcaccctccaagtcactgcaatggagaagccaaatcatcaatgcagagagctgctttcttccgtaactgtgatgtactgagttcactgagccatgctgtatttgtcatgcacatgagttctgaaaatcaataaaatctgtgaaccatcccacaaaaataaaatgcagtgaaaagagtctgctttgctcccttcaattactccagcatgaatggacccaacagctgtggtcttcagtgggacttccagggcaataaagtttttagaaatattgattttcttgatttatcaaattttcttgtttgagctttgcctaataaaacatcaaagttgagcatgtgaagctgcattaaagcatgatcttcctggcaagaagaatatggaataaaattggttgcatctttggatatgaaatagaaaaaaaatacctgaatcattttcaacaaaacatatgctcaaatactggtggagataaaaaccagttcaggtagatttctttgtcatgcttgaaaaatacttttcttcaaatacatattaaatatattactatctagagcatctaaagtgagagtctcttgtcacacatctagacaaaattaggattcctgtgactcatgtccccagtcattctacattggttgtcagagttcatatctcaactccagattcaggtccagtttgctggtccatcagaggctggaagcatgctgtgccagctgtgtctgtagacacagctgtgcgctgtgaaaaatgcacactcggttaaccctggaatgattttagatcctaaatattgcaaaggaaagagtatcttttggttttttgtgcctcaatatcctattgacatgaatgaattttgcttgataaatttgtaaagccaacagcctttcgacaaaaggggtgagaaacatatgtgtgttttgtaattgagtaaaaatggattttgagaatactatggaatattcatagattattggctttcgagttggaagagcaatttagggataattataacaatcatgataattggtgaccatttttaaatatggttctgccattgtatgatgtgttttatcaacaaatatattaggtacatgattcagttaacactacatccaatttaaagaagaggacaatccattctagaggagttaaatgacttgccccattcccacagttgattacttttcagagatgaacaacaaagtcaatgcttctatcttcttggtttacaaaggaattgcaaaccaaatttatgagagtgattagccttctcaaggatgacatgggactttgtcttttaaccagatgattgcagaagtgattggccattattgcttcctcaaacttctagttaccttgaaataactctataggacaatttattgctaagaatcttctatggaatactacttcaaaaatacatcagaggccaggcattgtggctcatgcctgaaatcccagcactttgggaagctgaggcaggcagatcacctgaggtcaggagttccagacctgcctggccaacatggtgaaaccccatctttactaaaaattctaaaattagccaagcatagtggcaggtgcctgtaatcccagctactcaggaggctgaggcaggaaaatcacttgaacccgggagatagaggctgtagtgagctgagattacgccactgcactccagcctgatcaacaaagcaagactccatctcagaaaaaaaaaaaaaaaaaaaaaccagaaaacaaaaatgcatcagtagacgttacttaaagctatataaaaatgttgttaaagaaaatgctgagttaaactaaacatattactttactgtaggacttatcactaccatgtttaatataaatatatgcattgcatatcttccagtagtgggtaccatgtggagcacttactaaatgtgtttcgtcatgtgactgttttatctgttttctcttaaataaatattgagtgctttgcaacacaaagtttagtgctctacggagatgaactttcctagagttaatattcatcgctagtagactatactgtgacaaaaataatgtaattactttgactattttccaccgtggatattaccggaatcacattatttcacagtcattattaaaatggccagaaagattagaaaagtaaaatacaatattggaaaaaaatagaaaactgaaaattgccaccatatctacttagtctttgacatggctatgtaaaaaacattggtcctgtatatggatgaacctcatgacttctgtaatattttagtggtgattttatgaaaacattgtccttttctaaagtccctgaaaatcagttttgtatcttcaaattagaaagctggagagagcaatgcgtcatggggttatggaagagagagtaggaatctggtcccaagtgaattcaaatacaccacttgggtcccattcatctactctctggcccatggtaccaacctggtccttccatgaaggtgccttttggagacagcagaatatcctaggcatttgcttcaattttccaattttagacccaaagtcaaatgtttcccaaatgatttaaattgatacacataggccactggcactgggatttccatttccttcctgggctttgtaactatagaaaaacaacttacgaaggaagatgtggggattcttctaccacaggtagtcaggtagacctgtccccagagatgaagaaatgtacatgggatatacgaatgaagggtgatgggaagggaaattgaggttaatgctgaggtttctggctgagagtctgaatacagtctactgtgagcaaaagtggttatggtgctttttgatttttaaaagttagctgagaggtgtgccgtggccagcagtgttggtagccagaaacttcccgtaaaccagagagcacactgcatccaagggctgtgctacaaatcagctttggtatgaatttaggacatttgcaagtattatgcctgttaccttaaatgggatttaggacctggtgcagtggctcacgcctgtaatcccagcactttgggaggccaaggtaggtggatcacttgaggccaggagttcgagaccagcctggccaacatggtgaaaccctgtctctactaaaaatacaaaaatcagccaggtgtggtggcgtatgcctataatcccagctactcaggaggcttaggcaggataattgcttgaacctgggaggcagaggttacagtgagctgagctcacgccactacacttcagcctgggcggcagagtgagattctgtctcaaaaataaataaataaataaatatataaataaaacaaaataaatgagattcagtctgtgctttttcaggatttaaatttgccaaaagaaattgaaattatacattgctagtctcattagagagttctgtcatattaggtgacactaacaagaaaaaaaatccatgtccaaaggctaaggctatcaggagcatctagttacaatgatcaaagtgatgattaaagaaaaataactatttcttgcctgtttaaagccatgccattacaacagactaattgaaatgtgaagcaaagattatgtagattttgcttgctggatgttgtaatgttaagactttattgatcaaaaagaggcaagtagcttttgaactgtattagcagttcttctactggttggaaatttattttctgatagtgtaagttaccagagcttcatcatgctgtgaagtgtatttcaagtcaaaaaaattaaattgaacccataatgcataagggtctttgtgccttgtaacctagtgaataagaacataggctttggaatcagaaccaccttaatttacatataaacttagccattgttttgaaaaagacaatcaagttttctaagcctcagttttttcaactgtaaaagtgggatattaacagccacctgaataagtctatttatgaccaaatggaatgaataccaggccctagaccagtaagtaccacataatcatcagcaaataaattggggaaataattataataataattatcacctctctgtcgggctagagtggaacttgaggttcatttaatccaagtcttacaatttgaatgaggacactgagtcacaaagtggaaacagtttcaaagtgcttttattcattcgatgatatattgtagaccccccatttgtcaagctctgtggtaggtactggcaaatgaaagtataagcattcaccatatatgcattcaccatgtatgtattcatacccagacccattcaaggactaattgatggcatctgtcccttaaggagttcggagtatacagaaggacacacatggtgaattttgtgctataacagagggctcaacaggttgctgatggaagaacagaagacaccatgactctgccaggaaagccacttcagagaaaaggtggtaacttatggggtcttgaaggaagaaaatgattaatgtcaaccatacagaccttctagactatgcagagaaagtatcaaccatattttactaatgagaaaaccaagaatttgaaaaaatgtattattagtcgatggttccatgatattttaggggcagaaatggaactaaaactcagggcttatcatctgtatctcttactacttctattctttctcccattctctcacatgaataatatctaagtttgcagaaagaaattagttcagcagtttaattacactgtggataacttttaatttattcatttctcatggaattatttcctcttgcttgatttatgcccttacttgatctatttcattttactttgattttcccctttgtaatcagatgatgcatctttgataatatttcattctctttctgtatatagccatttgtttttctccccctggagaactaattcatatatattctaaaaataagcaaatagtgtaaatgcaaatgggcttcaaatgatactttacaagcgcctaaattgaactttgtttcacttgtatcctgatgcaaaatgttcctaactttaagatcatctcccatagggccattccaattgtaaaatgaactctgcatctgattttcagattattggatctacatatttaccataactctgattaaaggcctttgaagcaaatggaccatagctgtttttgcaattgagccttattaaaatttaaagtgtatccgtaaacatgtaagtgcctattatagatcaaagttcagaaaattaaatattcacaaatacagctcattttacaaaaactacagacttgaaattatctaagccaaataatcttagcacttaccacaaaatagccttagttatttcagcagcaagattttatttatgttaagcaactttttgtgacttgagcaaaggttttattttacctggaaaactcagcatatatagctcttactcatggaacactgttgtaatattaagatataaaaatgataaagtaccacctcacattatatcatttaatgcatcagcaatgaaaccatttggggtttatttattttgctgattgacttgattcccttcctttggagaggttaataaagttgggcatatttcatgattattcaaataagatagcaaactttaatttctgtaaccctctaggagggttcagccaacaagtacaatactgtgtgctgttttaggatgtttagattggtgcctccacaaatgaaaaatgaggccttgtatttgttgatagcaagtagattgtactgcagaattaaaaggaaagaaatcaatgctgccaaaataaaacaatacaattagaaccacattttgacttgtctcagaaacattttttggtattaaagttattgggctattaaattgcgtggggaaaaataatagagctcattacatggagtgttctgctttgccacagctggagtctggattgcacactttaatattacttacatgtactggagcaagctgaagaaatacagattattaagaaataaccttttccattaggggagcttcaaagtcctcaggaccttttgggggtattagtgggaatataaagaagaatgaagtatctttttgccacgcattttccaatgtgaacaataaaatctattaaaaagtttgtttctgtttcaatatatttccctgatagaaagaaaagaaagagggagtttaagggagaaccgattaaagactaaaaatagaagggatggaactacaatttccttagatagcattgagacagacaactctgtttgatcatttaaggccaaagattaaatggtaactcagaaatttttaattatttccctcaacaataatttcagaaacaactcataggacttgtctttttacttgtggccatttaaatgatggtgggcagcagcagttctattgtttttccttattttggggagtggaccggttttatgcatactgtcttccactaaaaaaatcagacaaaaaagttaaaaaaagctgttaaggcaattaaattacttaccatctttactaaggaaagaatgatagatgcatggtaattgaggatttacctagttgctagggatggcagtaagagtttcacatacattacatcctttaatcgttcataaatcacttattttttggataacagaacctatccttgctttttggaaaatcacattgccttccacattgttcatttatgagaaggaccctgtgccctggctcaaaaggtaaacgtatgacccagatctggttaatgaaaacactgtggcaataaggacagacaattaggatgtgattatagcttggtcagggtatagaattctgggacttttcctgaaactatccaattttgagaaaaatcctctggtcatctactgtggatctacaagtagcaaaatctttctcttcctttctgtctctccatttgccttcttctgccctttttagacattctagtaactagctcactcaccatgaaaacaactatgaaagagtcatttttgaatacaaaacaaataaaccaaaggtttaatttaaaaaaaaaattgctgaaccctgggatacataagactgccaaaatacttattaaaacatataagcaattctaaaggagtcagaatgaatgcttagagtttaagtgactatcatcaacatttaatttaccgaggtggatgtgccattgaccactgatattaaagagccattaccaagaatgcacatatgagcacattacatctaaatggtcccttcacctctttctggatagcttgtgggaatcacttttaactatgctaattgtttatgccgagtaaacattcatgcttaaatgcctccaacaaaataacatgtaacatttgggaatttcgtggtaacttgatgacttttattatcagaaccaaataaagaacacatgtttattgcatattaaatagaaatgaggaaaatttcttaaccaaaacaaaaactttttttaaaaactgtagtaaactgcatattttctagaaggccaacaacaaaagcaaacctctctttaataagtattttatgttataaaattggaaaatttgtccacacgcagggatttaaaattgagttatcaaattccagattttaaactaaatatgaaaaagtgttgtgacctaaaaattatttcaagcttaagataccaaagtgaacaaaaatactttcacatttatattccacctctcaacactcgcgtaaatacacagaacccaaaatatcttttgcaattatcttaattactgttacctttgatttatcttacaagggtaatgcatttaaaattgtaatttctcattaatgtcagttaggttttaaaggattttaaaaacattacttctctgttggttggtctgatgttttaaatatgtttgattcaaataatacagatgttataactaaaggatcagtttccatagggccataattttgcaatgctaataactactagattttttttaaagataggtatttcccacaagcacatttgtatatattggcagaaggaatggatatgttaaaaaatgattcaaacacaaatggtttccttcaacttaatgttttaaactttctgtgtgtttgaagcatttctccaaaaacatgatgatggaacatgcattggaagaagaatcagaaaagtcaaatttttacataaagtctgttaactcctttgctgtgtgaatattgacacattgcttaacattgcttaatctttctgtgtgttactatattcaaattgggaattgcattacttgcattacatatctttccacaatttatatgaaaatcaaatgggataacagatatgataggcaacgaaaattccaaaatgctaaattaatgaatgggtgctctgttcatcacttaccaatctaatatttaatgagctactactcaatatatagataatttagaaaaagtactcaaatatgacagtaggagagacacataaaatatgttaagtcctataagaaaggtttagttcaaatgctaagagaattcagagacagggaaagataattttgactgagagagaggactaggagggaaagtagaagtgacgctatttgaactgggtcttgggaaacactaggacctggatctcagatgagaaaacatgttttaagtaggggaggagataatggatttgaaggtttagggttatctattgcctgttttgagtgcatgatataatgcatttcacttcttcagttaactaaaagaatcacgtaaattgtttaaaaggagtagaagatcttgaataatcatatacctttttactaagcaattaatatatctaagacattgtttttatctactatctcagtgttgtgatatgagtattattgctattatatccattgatagattagaaaattgaaattacaacaaaaattacttgactccaaaaccacggatctcccctacatcctgctctattattctcttgtaaaatagattgtggttctttttatttctgtaacttaaaacatttttccattgatgtcattctttcaactacacgttgagtgcaaagatgaggtgcttgctctcaaatgggaagtaggaagttgaacagagttgtccttcttccatggatttaatgaggaattaagattcagaaatgagctctcatgtgcacctatccagccctccaacacccactcctcaatggactaaatatttaacctaggtggaaaagaactcacacattggaggaggactaacatgtgacttcctttgcacatgacccaggatcataagtgggggaccttctatttgctctttacattcagtcttctgctcattgtcacatatgcccatgatcttaaaagcaagccactagagtgtgtttctaagagcatagctataattcagataaatgtggagaaaatttgtaattccgtgtcttagtctgtttagtgttactatgaagagatacctgaggctgggtaatgtataaagaaaagttaatttggctcaccctcccacaggctgtaaaagaagcacagcaccagcatctgcttatggtgagggcttcaggatgcttccactcatggtggaagggaaaaaggagctagtgtgtgcagaggtgacgcagtgagagaggaagcaagagagagagtggagatgccaggttctgttttaacaaatagctcttaagggaactagcagagggagaactccctcattaccacaaggacaacaccaagcttttcaggagggatctaacccccttgagtcaaacatctcccccaattaggccacacttctaacagtgaggatcaaatttcaacatgaggtttgggttgggggctaatatgcaaaccatagctttcccttactagcagagtgacccaaggcaagttgcatacaatggagataaaaatcctgtgttaatcagcttgggctaccataacaaaataccatagacctgttggatcaaacagcagacattggtttctcacagtttcagaggctgagtagtctaagaccaaggggctggctaatgccattctgcgtcagggccctcttcctggcttgcagatggccgctttcttattatatcttcacatggtagagaaaaagtgatctctggtctcccttcttttactttcgaaagtgctaatctcatcatgggagccctaccttcatgatttcacccaaatctaattacctccaaggagccccacctgtaaaaatgatcacattgggtgttaaggcttcaacatacaaattttgagacacaattcagtccatggcaaatactgtagggtagtttcaaactttcataaacataaatatgtgaactatttagcctcaaacctggcatataggtacattgaaatggcaactatttgtgtcatacggctattcatgttttacatccacatagtaccatctcctacaacattcacctaaagcaactgattggcaatgacattcattacagatttatagctattcaataatcatttacagaatactctgtgtctggcactgtgttgggtgaggagaggagaaagtatataaaaagttgagtaatttaaagctcttatttttgaaaaactcatagaaaaatgaggagtgcagagagctctaaagagattgctgaaatataaaatgggattagaccatggggaaaactggtgactgattctgccagaccaaatcaaagaaagctttaaagagaagtgatgtttcaagcagctctggatatccaagtagaatttatctgccagatagcacaaaaaaagaaggatgctctaagtagaaacaatagtatctgataagcagggaagcatgagcaagcaaagaactgtagggaaactaatgggagacaggaattgttggagcaacagtcacatacaggaacaggtaaagaaacacagtcaatgtcactgagaactggattgtgagatccctctgattccacaatcaagagacagggcggagccgaaagtatttttaatttaatgttggcaatagtgtgaagaatgagttggtctgggatgagacaggtggcaagaggccagtcaggacaccagtgtcacagtctctagacaacaggtgaatagacctattgatatggtttggatttgtatccctacccaaatctcatgtcaaattgtaattcccagtgttggaagaggggcctattgggaagtgattagatcatgggagtgggcttcccccttgctattcttgtgcggtgagtgagttctcaggagatctggttgtttaaaagtttatagcacctcccccttcgctctcttcctcctgctccacccatgtaagacatgtctgcttccccattcgccatccaccatgattgtaagtttcctgagtcctccccagccaagcttcctgtacagtttatggaactgtcagccaattaaaccttctttctttataaattacccagtatcagatagttcttcatatcaatgtgagaacagactaatacacttatacaaggcagtagaggtagaaaggaagagacaatacttagagacatttgggagtaagaagacttagagcttccatttcaggtggattgagagatttactcctgatgagaggtcaaaggattcctattgaaccagacatcagttgctggggaacagtcatatgtgactgcaacatcaaggaacccacaaatgcagcctcgcacacatacaggacataaagccaaactgcaaaaggtaacacatcaaaatacctctatattgtgtaatgccagatttgtgtaaatcagaaaagaactgccaggctcaccaacaacctcatttatattacggtaactatcaataccgaaaactgttatttcctattatatttttaaaaagtcaaattaataaacttcaattatgaacaaccagcatttattaattatctcctataatcactatgacaaagatagttaattccctgcccggtatatatgcttgcttctactttaagaacaaatccacaattttattaagattagcaagtacccaatttaataaatatatatgtgtagatctatatattatatagatatgtgtacatttgtgtatatatacacatacctatattttttccttctctcatgaagctaggggtggccaatgagatatgaatggaagccactggctgatgtatctgaggacctctttataggggtctagacttatatggaagggggcccattgtcctccctgccaccccctctttcttgcttcttggatgaatttgtaaaggccagaactcatgaatagacacaagcaccaatcttagtagaataaaacaaaacaaaacaaaaaaccttagtatacataataaaaatttaacactaagttgtatcagctaacactatttggattttctgatgtgtacaatgcaacctaattaacatgtcatatagccagcatcatgcttagagccagggaaagcaaagataactaaaatacataaaccatctgaaataccacaggatagggaatataactttaaaaacaatacctttccattccccacccaaatagtctaatataaactgaaaactggatgaggatggaagttactttgtagtcacgacaatattgagtatcctgaggaatcagttctctatcaagtagcgtgagtgataactcatacctcatctcaaagcttaacatttttctaggtaccagtggggcagaaacacatgattcctagtcccaaacagttcacaacgcagaaggggagccagaacagtacttgataataagtagcatatatttatggccatagtcagcgctgctatgtagtttttaattcaacaaatattccccatgataacttgccctgagggagagagtcatgagtgtgcaacaatattgccctgttttcaaaactaggttttgagggggaggataaatagaattcaaatcgtattataatatggtagacttgtgtgaacttaataagtgacaatcctggtggaccccaaattcatgtgttgagtttctaatccctaccacctcagaatgtcaccttatttgaaaataagatcattgcaaaagcaatttctagttatgatgaggtcatagtggagtaaagtgggcccctaaaccaatatgactgatgtccttatgaaaaggagatatttggacatagacatatacacagggacaaggctgtgtgaacctgatggttgatattgagtgtcaacttgattgaattgaaggatgcacagtattgttcctgtgtgtatctgtaagggtgttgccagaggagattcacatttgagtcagtgggctgggagatgcagacccaccctcaatctgggtgggcaccatctaatcagctgccagcataaaagcaggcatggaaagagcagacttgctgagtcttccagccaccatctttctcctgtgctggatgcttcctaagttcaaacatcagactctaagttcttcagctgttggactcttggacttaccccagtgctttgccaggggctctctgtggcctttggccacagactgaagactgcactatgggcttcccaacttttgagttgttgggattcggactggcttcctggctcctcagcttgcagacagccttttgtggcacttcaccttgtgactgtgtgagtcaattctaataaaatcctcttcatatattcatctatcctgttagttgtgtccctttagagaacactgactaatacagtgaagatgaaggaaaaactctgggtaatgcttcttcttcatggcaaggaatgtcaaaaatggtcaataaaccaccagatactagggaagaggcatgggtaagatcactctcaccgcattcagagcgaatcaaccctgctgatgccttgatctcagattttgagcctccaaacctgtgagacaatatattcctattgtttaagccacccactcaattagcaatactttgttcaggctgctctaacaaactaagacaagctttaatggagtctacaagtttgttgagacatgtttaagtcccatgcactaggacactgatattctaaaaaaaaaaaaaaaaaaaaaaaaaaaaaaagcttgattgacaagtaaacccagattttgttgaatatttcaacataataacacttgaaagaaaataatagaaaaactttgcttcttgaggaggaaacagccctgttctaaaactgcttaccatgagtgctagtgaaagaattataaagaaagtacagaactttagtaatttgatagtagaatattatgaatttgaggattcatgacattcttgggatacattttagaaaaactgagaaagggcttcctcacatagcaaaggaggtaaaattcaaaaatgatataaaaataagcactatgagaggataaaagagaaaaagaatacattgtgggatcagaaaaggaggtggcatttgagaagaaacttgaaggatgttctattaatcagagtctggtgttttagacaaagtctatttaatactgaccattggttactcgggtgattaaagactgaagcttctggggatgttgatgtaacccagagctcaacagctttaggaagttgctaccattcttcaggccagcaggggagaaaaaaagaaagaatgaacgaatctgaaaggagaagctccctgcagttggtagttggacctcttagggaaaaaaagccattgtttcacacatactagaccactgagggggcctggctgtttttttacacatctcagaggggctctgctgtgtgttgggagaatgggggtgggctatgtggtactccccccactcaggtaaagtgacatcagggctagaagtgtcaaggaagttggaggctgaagccatcgttgtctgcctcaaatggagagggagacccaacctggaagtcagaaaagaatccttcttccaacttccacctcctgtccacatttcctactggcaaaatctacccagagatggctgaaaatgggagtctggaaaatgtaatttttggaaccttaatcctaacttctcagaaaagagtaggtggtggatagcggtaggacttggaactaatagccaacaggtaaaagaggcagagatgtagaggttttaatgtaaagaaacagggtgaaaaggaggtatttcccgtttcctgaaggccctgagcattggtaaagagtctggaatggaaaaggacagtttggtcaataatggtgattccctgatgtaggtcagaaatgggtctaggtgatagaaatgttaacgtgaacaaaatatacaatagctgtttgtagactatttaatttaaccttagcatcaagcatgtaatataggaagaagtagaaaataagtctaaaaagggaggacaggagcctagaactgcattctggataacttgtggcatccatatgggagaaggatatataactcaataaatcatgtttaatatcagtggcttttgaaaatgagtctgaagcatgtcaatggattaggaacattaattcagagggtttatagaatagattcacttttcctaatagtcaaagttattattttatcattttcatcattatcattgtcatcattatcataattacaatgtttatccagtactcaatatatagcagaaattgagcactttcctatatcacatcgaaccctccaaacaacactatacagcagctgttattttccctattttatatgggaagtaactgaagatcaaatagagtacatcttttggtcaaagtcatattggttcgacgtggttgaacctggattcaaactcaagtctgaccctagatttctttctcttaagcattacatgcttctccgtttgagaaaaggacatctagactcacatctcctttcaaaatattgtcatccatgaggtcacctcaagactcaagtgccacctggcagcttgagccatttctctaagttcttcgttcagttcatttataatcccctctgagtgttacttctccgccttctcacttctttaggtttgtcacagtcctctgagatgacaggctgagcaatggtgatgagaattatggtaatataaattccataaacagaagagtctaccaggagtggacacaaagaagttcacagagggcgcatctgggtgagaacagccccagctgttatagcatatgtgcaaaataatgatgtgcctgcacatccatgcagacctgatcctagctgtttataagaaaggatagttaaatgcagaaatgcaaatctgtaggctggagttgctctgtttcctaagtcttaagagtttggctccttatcttacacacaaaaatgcaatagacaaaacctccacataaataagcagcaggtgaactagcattttcttgccaaggtattatgcaagtgttaactgagctgatcagcagaagcacatatccatcagtttcactgcagaaagcaggaagaggaaggtgaagatgagcaggcaagttaaatgaaaactcatctggcttgcagaagagacacttattgctcagaggaggaaggtgcccaggggtcatgagatgtgacagtactaacagaaaatcctgagcttgcaaactctgataaatgtttaagatttaatggggagtgtccacacaaatgcaaaatgatttagaaaaaggtaaatgatcataacaatgttaataacatctatcaagcactttgctgagtattttgcttacattaataccccattatctaatcaaactcataggatatgtatggcacactatttcattgaagaaacagattcttagagatgtaaagtaactttccaaaagtataggtattttagatatatatattatagacctagcaaataagatgcaaaaatagaatttaaacttagaactgcctaacttagaaattactataaccaaatgctctacttcacatcctgattgctggggattccatttgaaatagccagatcatatataagtacatatctgtacacagaagtacatctatttctaaaagagactgctacttgtcaaatagtcaggcaagtatgtgttttggctctgtgatgtgataggaccagttttgaatctcctattttaacaaaatgtgttgcttatttttgttattttacatcatggaaacttagtttgttcagcctgaagagtttatgatggcctcctgtattcttcctgtaacgtgttcaaattctagggtaaaataaatttaaaacacaaacccaggatgtgtccttttaagctcttataaaggatatcatgtagataagccaataaaaaccacaaaactcccaatttggtcaaaagggaccttactgtattaatatatgcatcctaattcatgcagtcacttaatttctcatcatcttccttctaaacaccattccatgcacattttatatagcaacattgctgaaaaaaatgcatggatccacaaagatctctcatcttttttttttttttttgagacttgctttgccacccaggctggagtgctatggcatgacctcagctcactgcaacctctgcctcctgagttcaagtgattcttgtgcctcagctcccccaagtatctgggattacaggcatgtgccaccacacccagctaatttttgtatttttagtgaagatggggtttctccatgttggccagactgctctttaactcctgacctcaggtgatccactggcctctggctcccaaagtgctgggattataggcgtgagccattccacctggtctcatccttcttttcttgcctttgtggattctgttctctcatgatcttttccctatctcttagttgtactacaagattcagtttggtcttcatcttttcagcaaactttccttgacttaggtattagtgtccatctcagctattcagaatcatcccaggcatgttattattatcaccactgtttagtggtaaacagtgggaatggtcatagcattagcggtagtagcattagtagcagcaacaataatggaagaggtagtgatactcatacttgaccttagtgagtatctccaatatgtcaggcacagtaccaggaactttaaatgtatgaactctaatccactaaaactacatgaatcagcatgaatttattatccccactttatgactgagggaaactgagtttctcttttatcagtggctgtttctccctaattttctgttttcatgctccccatttttctctcttaagcaccttagatatttctttatttatcttgtatttgtgttctattgtttctcagatttctaaatcattgatttctagttttacccttattaattctgttctcgttccttgggatttattttttttcttttctaacagtttgaacctaattgcttaattcacttaaattttcccattttattaattcatctatgtaaggccagtaattttcctctgagcaataccttagctgtgttctctagtacctaaatttatattttatctattctgagacacaactttttaaggtcatttcaacttatgacatattttagaattaagagatatcttcatctaggggtgaatgatatgcatgttagtacactacgctccattttgatcaatttccaatgattatcagccaggttacagtcctgacatagctgataactaatgttggaaactggatagactgggacattgttcctgttggcttatgtgccttattgatgctgaaaagctaagtttagttactgtttcaaatacctttattttgttgatctaaaatattctatgaacactttccaagaagatctacctttaaaaatttcaaaatgggtgtcaacggcttggaagagaatttgggagataatagtggagcactctcccaactcaggctgcaatactaatgcacttagtgtcacagtaggagaaaaattctaacgactgtaacagagttgagtcatggtttatgggcagaaattttcttgttaatgaacacaagagaaccatgcatcttacaaatggtggtgtcttagattaataaaaaaattaatatttgttttctgtaagtttatcgtgtacctgaaatttacaatttcattttcattttcattttgacctatgggcctttgagcaagttttcaaaatctccaggtgaaactggcgtttttcttttcagtttgtttttaatttccagctttcttgtatagagatcaaagagagtgttctatatttatatatttaaataatttattgaggtttttgtggccttaatatatggcaggtttaatcaatgtttccaagctatttgaatagaaaaagattcccctcttttgaagaaacggagtccttatatacttacaggagatgttcggcagccttttatttaaatggggtgataaataaaataaaattctaaaatcattgcagaaggtgaaaaattaaagaaggatccagatttgaaggagactatagtctttagtagtcaatagtgaaccctcaaattgagagtgtaaggcagagtgtacacttgaagagctggataatatgaaccaagactaacagaagctaaaactagatttcagagtgaaatcagaaagaaagtatcttgacaacaaaataatgtcttatgcctagtctctctactactcttgttctcaagtttgccttatttcaacattcccagtatttctgtctttaatttttaccatttttgagaatctgagaactatctgtactattattatcctgacaactttctccaaatctattttataccaattcactctcacttgttatgtagctttgcatttagtaaaaatatccatgaactaatggaattatgtaatgtgtatgtcattatatatgactgtttttaaaagtttgtcaacatattttctagaagaatctcactgatcctttgtacaatactgcataacttgtaaacacttatgctgactccagcctctgtgggagaggaggtgatcttgccctcaaactgacttcagggaggtcagtcacaaaggtgacagctgggtagccatggagtttaaactaagagtcacttgaaataagtagaagtaagtacatcagaggctagacagaacacttgaatcaagagtccaagatgatttggaggttttgagataggaaagtttagggcacatcactttgattttgaattgagttcaatagttcctacattaggggttggattttcaggaacataagaaggaaaatgtttctgcctattatttcttatacctaaggaacaactgggctattgaatgagaataatgtccaataccttactgctgatacttcctatttttctccttctccttatcttttccttcccctccccttcttcctcttttctcttcctcctcttccttttctttctttagctaacttcttagtagttatttagatacacgttttctgttatctgcataatttgtcatcttcacaagattctacattcatctctgaatttattgtactatactgagactcattctcaaatatttaaatcacattttatattgcaatcttcgtgtgatagtttataacaaaccaaatttatttcaatagttaattatggaataggtagacagatgctgctttgatagtatgaaaagtatcacaaattatattatttcaaaagaaaattataattaaatgtcagcttccaacagtcacatacaaatctgcatatgatctgccaatgcagacaacccttagaatggtcttgaaaatcccatattaaagatgatagagtcatcagatggaaggagcttggtcccctaagtcatcacttggaagagagccattcatttgcgtatacttcttagggctcacaggtgagcaagaaaataaactatttggttaaacaactgaaaatttttttagtttgttgctcacaggagttggcctattgtgtgaggcttagcaaatatcggtagaatgacagactgagtcaataagtaaatgctgctactcaacatttgtttctgcccatagaagcctaaattttttagtggtttgtttcttgtctccaacttaaaaaccctgacattggagattctaagaaatcaactgatttaagactgcttcacataaagcatcttttatggggtgaaaaccaagaagcataaaagcccactgctctgctatatgacagttcccgtaggtataacataaaccaaggtcacgtcggcactaagccagagcacagtattttgcattttctgctaatgccgaaaaacacatttaaatatcctgttactgaaaaaaaatctaaattttctttgaaaattttggataccaaagtagaaacattagacctcgcttgcatactgactaaaaatcaatgccctaaaattgctgagtgcactcagaattatttgatatgctgtccaaacttgtttatgaaaatatattttggatgtgaggtataagtccccgattactcatttatccaaattgctaaatgtttagaagacttcaaagtaatttaaattattccttttattgatttattactttctttaatattcataataacttttgctcttaaccctgacctcataacatttgaagtgctatgataataattatcttatattaatatgctaatttcttcaaacagtacattcaactgaaacttcttaaggttttaaccactgtagacttaattaggttaattaaaatactattctattttatttttactttgtgattgctccattatcatataatgacactcataatagtaatagaatttattatttattgagcatatcttttcttcctaaaacattagttttatgattaacttcataaaaaaattaaataggtgcataccctgtgtggttttacctattcttttttagtttaataaataccaccccataaatgaataccaacttatcttccagtcatatatagtattaaacctaccaaatctatttagctaagagaaatttacttgggcttgaatatgctatcctggatgctacactgtgacttcagcctaaggagtttcccctgtctgaaaaacccttgactctaactggacagcaatagtaatctctgtgccaatttctaaagaggctgcagattgcaagacacctcatgatctggccttgcacaactcttctgccctctattacttttagaactgcaattccagctgcgcactgtggctcacccctgtaatcccagcacttttggaggctgaggtgggcagaccacctgaggtcaggtgttcgagaccagcctggccaatatagcaaaactctctctctactaaaagtacaaaaaattaggcaggcattgtggcaggcacctgtaatcccagctacttgggaggctgaggtaggagaatcgcttgaacccaggaggcggaggttacagtgagccgagatcgcgccattgcattccagccggaataacaagagcgaaactccatcttaaaaacaaacaaacaaacaaacaaacaaaaaactgcaattccataaatgcagtatattctttggtgcctctatgccgttgcacactctgcttcctctgctgcagctggcattctttgccttgaccacctagttagctccttcctctatttggaaattctgtccagaagatacctttcattcctggtgtcatcatttggtattttctcttttgcttgtctctgcttctgtcatcatgtgctacatcctgctctccatcatttactagtattcattttatgccagccactttactattcttacatatattctggagaattgttttagaaaactcacaagtttaacattgttatccacattttagaagcaagaaaaactaaactatttgttcactctggctaatgtgtagattattaagagttcaggccgggcgcggtggctcacgcctgtaatcccagcagtttgggagaacgaggtgggtggatcacgaagtcaggcattcaagaccagccttgccaacatggtgaaaccctgtctctactaaagatacaaaaattagccgggcgtggtagcgggcacctgtaatcccagctacttaggaggctgaggcagagaattgcctgaacccgggaggcggacgttgcagtgagccgagattgcgccactgcactccaacctgggtgacagagcgagactccgtctcaaaaaaaaaaaaaaaaaaaaaaaaaagagttcatgctagctaaatgtgaatttctcctgaattctacctaaggtctgtctgcttctaaagcccagtttttatatgctcaggtaaatatttgcttgtttccagacatatgacaaaacatgggcattaacaaaggagaaaaagaaaaacggagcaggagagagaaaataagagagactaagtaagaaattttaaataatttaaatatggcatccacccttctactcagtggatgaatgaccaagactgcattagaataaagcaaatctgctcatccgtgccatctcaacccctgggacctcatagaatgtgagtttcttccagttcgagtataatgctagtatttaatcacatgtgtttcttctacctcttggcaactgagggcaagcaaatgacttcgtcttgtactcagttaaagaaacagtgaccttttctgagcatgaaggtcatacatcccacactggactaactcaggggcagtccttctctgtgatattgcaccttcttaaagtacatttgtcttgcatacggattttagagaccaattgttttgcatgctgcaggtgcttaacaaatatcagtagaatgacagactcggtcaataaataaacgctactactcaacatttgtttctgctcatagaagcctaaatttttttcgtggtttgtttcttgtctccaacttaaagaacctgacattggagattctaagagatcaactgatttaagactgcttcatataaagcatcttttatgcggtgaaaaccaagaagcataaaaacccactgctctgctgtatgacagttcccgtaggtataacataaaccaaggtcacatcagcactaagccagagcacagtattttgcattttctgataatgcagaaaaacacacttaaagccacagtactgtttgaatagaacacaagtacaagatgagcctacgagttcatccaaaataaataaaactactgtggggaaaagttgatttattaaatttctttcatcccagaagaatatattaagaatattatttatatcctttgcatatcttccttctaattagattcccttgtgccatgttaaaaattgatttaatcttatttatttatatcttatttgtaaactgcttgctatgtaatctattaattgctgtttcaattaaattctatatatccattcatgcatttgtttatcctcccatggattgtttctcatcataactctacattcagaattctggaggcatttacccactgggagcaactaccctcaaacaccttgctttttattgctgaaaacccttgtactctactgagaataaactactgatactctccatgttctcagagtaaatggataattcagtacagttgaacacaatgtaattctaggttttattctccataaattgccttttagcatagagataaaaactttatttaactaaatgtttccctttatcctgactcatgtagcagaacaagaatatataacacagtaaaaattccttttgaagagtagttttttagctgatttggatgctttccaataaactcagtttttcacagaacgcttaggtaagtagggagattcattgaacattacaacgagaattatcaatggaccttaactacagctaaatatataatttccagttgtaatataggtgcccaaatatgtgttgaaataaaacatatttacttgtgtagttaaggggtaatgtctatataccactgaattttactagccatatctatgaattttatctagactacttaaacagtatcagggttctcagtgtatgcgttctcatgtttggaaagaataaggaatgaatctttactgagccatgaccttgagccagagactcttttaggccttatctatctcctttgatactaatactatcacgtttgagtattattgacctatgttccacataaagacacctcatctgggaacatttaaacacaaggttacaatgttaataggtgacagaaactacatttagctctggatatgtcttgttttaaagccagccttctttgtatacgaaagttttgctcaagatatttaaaagaaaattgtattttacaaaatgaagaatcccttgatgggattgcttaatatcagctagataaaatatttttaaaagtatactaccgaatattgttgcatcaaaactgtatttgcccaagggtggcatggagaaaacactctcctttatgtgattatccaaaaattttcatacaaagtaaacaaatgtttaaaatgatcattctcagcattctcccaaatatttttacatttgccatgcataccatgcacacatttaacgcacaccattacatcaaagatggtaaatgcccaatcttacttccctctcctctagaaaatcatctaggcatttagtcaacaagtaccttatacagtgtcaaggggagccattaaaaacatggtatacagaaattggatttcctttcctgagtattgcaacgaagaatggaagagaaaagccaggctgctagcatttctccttttgtaaggatatgtcagcctattcagagaacaaatgacccaagtcaatgagtgtgctgagagcttatccaggagagctgacactcaacttaagctaaacttataaactgtagtgcatgttcaatttattttatcttctgcatttcactctgtcactccacttgatgacattaagtatagccttgcaaaggaaatagtatctatttctgaaaggtttaggtgaaacatcattatatttccatttctgaaaggtttaggtgaaacatcattatatttccaaacaaaatgaaaacaagcaccttggtagaggaacggcataaaaacaaacaagcaggaggtctgttattttcaagggaattgacaacttaagaaattcacagttctacatttaaaatgtcttcctttttaggaaaattccatggcctcttctgaaacatctggaaaagactatagacatgttctttggatgcaagttatggatccatacaaaacgtattgatccttatataataaaacccacaatattcggggggaggtaaagaagataggaaggtaacggatgagagtttggctacagtcatgcaaatctgggttttaattctgactttgccagtctcaagtctctgtagaatcgggaaaagtattttcaaagcctctgctccttcatctgtaaaatgaagataataaatagtacctattgtatctgcacagttattaaagggcttaaatcatagaatatacccaaaatgaagttttgcataatgcattctcaaagacattgttcagtacattttgactagcattattatttatattatcacagcttggttcagtccctcatcacttctcacttgaagaactgcctccttcagtcagttcatactaaacatttggtcaaactcatgtgatcctgtcattgtcttaattattaacctcttacaaataccccctatttacacagaatgtttttcaaactccaggtcatgatccattaatgggtcatgaacccaatttaatgatgagtcgagaccaaacttaaaagaagaaagaataaaatggcatgactacatagggcatagaaagatagaatagactacatagggcatagaagaatagaatagaatagaatagaatggaatggaatggaatggaatggaatggaatggaatggaatggaatggaatggaatgggatgggatattgtcagagaatatgacacatagcaaaggtaaaacatatttttgaaatcatttattacaattagtatgtacatgtgtgtgtgctgtactataatgtaaaatatatgttcttacttactaggtaatattcaaagtcatctgacaagcattgggcaggatgatgtccaacattaatgctctgctactcatctagccactgaccctggtcactcaatattcaagacttaatgaatggaaagtggaagatgcattttgccttccttttgcttttgaggtgaggtaagtggtttagtatgatggaaagtggagtacaataggactttgattttatgagttggtaatttttttaacctaattttctgattcaataatagaaataaatatactttagactttaaatgctaataataccccatcattgcccttcctattctatcttcagaaaaagtgaatataatcattactgaaagtattatgcacaaaaaataggatcagaaatacaagtttaaaaatttctgtgacctgagatttttgtgtacatattagaatagtatttttccatttattgagttaaaatgtttctttatgcaaataccttttcaaacaaagacatttccaacacaaatccatgaatccaacttataaataaactatgaacactggacacaatgcatgcaaacaggacatctggaatgaaaatgcaccctcctgagataactaggaagtctccattttacatttagctagtcactcaagcatgaagtagtcttttgggaagaatgagaagaaagaggatcaaatatgttaaaactagtgtgtgcacccatcctagatcatagcatttttagtttcaaagattctcattgcctttctcacactagcaatgctcataaatcgggcctttaactaaaaatccacaactgccctaattctaagtggtaagagagaactcaaatgcaaaatcagactcatgtccatgcttataatgtttccatttcccctttgaagaaaaccgccctcagtaaaaccaaaagtgaattttagtgcatatccatcatcttaaaaaaatggattttacaaattaagcattatgaacaatttgtaagtgcattctaatactgtacacagagttgagagccaaggattttagcatctgataaatctaaagttaaatatctgagttcaaggccaactcaactattttctagctttgtggatttaggaagttatttaggcttgctgtgcttcaggatcctcatgggcaaaattaagattaaaatatctactttataaggtagaagtgatacttaaataaggcaatatatatatgaaacagttactccaggatctgacatacaataagtgctcaataaatggtagctattaaggttgagaatagtcataaagaagtcctaggaactagctaaatagtaaaataccaggattatatactctgcctttcacaaaataagtgctattagggaaaatgttttaacatcagcatttaaaactataatattttaatgcaattccaatataaatttatgtttaaagggtaaattttcatggttgaaataccgaacaaagcccattataaaaatgttttatttcacccatttcttctgagttccaagcagggaagataaagaaagaaaccaaatgagtagatgattttacatgataaactcgagaaaaatcaagatggtgcttcagtgacacacagaagtttcttacacatagtgatagtcaaaactagtttactgaattagaacatcatgtaaatatttcattataagattttttgtgtgtggtaaaatttctgttcttttcttgcatatgttatttatgaacataaaacatgcctcactcatcctcatgagtctccacaatgcctggcagatagcaggcactcaatgaacttaatttgaataataacataagatttatattacaagtaaacaaggatttactgctcagcaatctgcatagcccatggttagctacaaccaaacctttgaggtagcctgcctttacatgagcagttggaaaaatcattaccctcattttaattttccttctcccattaacgcttatacttcagtgagaataaagttaaatgagtgtctttttcttcctaggttgcttacatttttaaacataaatctcagacctaaaagttttgtttcccttttgaaaacaaaattaatttagaaaaatgtaatcaggttttaattttttaattcataaagggcaactaatttctcaacctaaattatagtacaaatttaccaaaattattttagtcataaagaatttgcataccataacagaatcattcttcgaaaacttaaagccaaatctaatacacacacattaagattttaggaaactgacaagccagaatataattaagtgaaaatttagagagtatagagagcaaattggccaaattaatttaaaataggaaattaattgagcacctacaattattactaatcctcaaaataaccaattagctggcattattccccctttagagagagcaaggctcagactcagagacatgtggctcaagaccatgcaaccagtgagggaaaattctaaattcaatcctatgtctgtcaaccttcaaagcttgatttctttccactacactttagtgctggaataaaaacttggaaggaacacactcacacaaagaaagattgatagtgatgagagggagaaaagtgcgaatttgaaggaagatgaagtaacttcttgaaaacgtttgagctttgtagaggagcaatatacgtaatcctctccaagcaagtgtaaccatttcttatgaatggctgagttttattttatttcatttttgtaggaaaaaactgaggtggagaaagcaagtggcccaaggcaaaaatagcagttgaacaaaaagcttaacatagtgaatacttacacttagcacaggatttgccaaatatagttgtttcataaacatttttggaacatataacagtaatcattaataagtatagaatgttcagtgaccccagtgctggggtaagcatttggcatgtaactgacatttctcatgacagtgctatgaggtgggtgttgttctcatctccatcctctgcatgaggatactgacattcagagagcttatgctgcatgcccacttcccaagtcggtagagacctggcctggtccaggaactctgcttcagatccccagatcctacttactatgcttcactgaatgaatagaataatcaggacattcttatctcaatccaattacttataaatcaaatttttgctgcaaagtttatcatcaagacttaaattacttttataaaataaaataaatactacttacacaactgaaattaagtgaaaacaaaggaaagaaattgccatatatttcactgtgtcatgagaatgagagtcattgatcttggcagatctgaagcatcctctctgctctttaaatgccaaactgatagattgtcaggacaagtgaaaaatatgcctgaaaactcatcaatacccatatattacaggaagcattgcccgcaaaaacaattatgcttgaatatgtgatagaagtcttagtgtataaaatccattatggcagaaattagaaatgagaggaaattccaagaagcttaatttattgattattattttcatgaagtgagggtgttggaaggaaaacaaaaccttgagataatggaacagagaagtataattaagaaatatgtatgatgtttatcagttttaaagactacaatggatcatgattataattaagttgaacaactaccaaagaatactcattgataaaattaatacttgcctaaaaagagagtctctatcctttggtgaagaagagaaactgatttttatgaacaataatgatactgtttaaggataatgcatatgtgtgacactatactaagcactcactcacactgtgtgatttaattttctcagcaattaattaagaaccagcaatgagttaagaactccattacataaatgttgggacaaaaaaggcaaaataaaaaacttgacctattctagtatcatcctgtagttttcatttatagcacatttccaattgttaattatacacttaattatatatttatttaagtgtgtattcatttttaaattatatgttccataagaagagggatcgtagatttaatttatctctacatatccagagtctggctcattgtaggtgctcagaatatatgtgttgaataaacttatgaataaaagagatgatgtcagagttccagcatctaaatgcaaagacattccatacacttgcctcccccagtgtctccctttgggtgaatgtggaggggatgggtgttaggcgtgtgggagcagcagtgagatcccagaacagttaaggggagatttttttaaaaatcaaaggaaggtgtgacaggaactgaattaaaaggttccaaaaagaaaagctccaagatttaagatcttccctttgatactaatcaatttattgaagactcttgacaaagaacaagagaaagagcaaacaaaactgataggacggagcctgatgcattagtcacttgtcaaaatttgttggtaactgaagagaaagtatgtttagcttccaagtccatttataaaaatatggttctcctgatactaaaataacccctggattcttccatagtaagggaaaggaaaaaatgtaatcatcacttatgtgtgtgctattctgaactcaggctattttttaattggaataaggtatcaagtctcagccttatcattttaaagtagtagttcccacaaggtatgattaggaccattatttataacaaaaagcaaaagctgtagtcttattctcgctagccaggagtgaaatggtgttcacttatcaacaaaactatctttgttctcaagaaggttgaagttattacccaccaaggactgctttgcatctactttgaggaattaagacatcaacaccaactagagatggcacaccattgttgtttgtgtatatgctatgtagatggttagattttacatcaagccctggatttattatctgagggcagatgtgtttaaaatcccgcactattgggtataagtaactttgtggatgccacacagccactctagctatccattttctcatgtcagagacagaatgataattcctgacctatctcctgaagctactggaaaaatcacaaatgaggtaagggatataaaaacaccacataaaccataaagtgcacttttcattttaacataacccatcactctttctttacatcactccatttaatttctgcattcaggtgtcaattttcaaaatagaaagacagtcttatcttcagttgtgttggcagatccagctgagtaaatgaagagttagagcttgggaaatgtgctcttccctgcaaacaacaacaacaacaacaacaaaaaccacaacagtaataatggctaacatgtattaagtgcttattctatcccagacgattttctaactcactgcagctgacctgcagtaggacaactccattctgatattgggtcaggtcatgggtgaactagcataggaatgaccaagagaaccattgtgtttgccatgttcatagtataagaaactggttcttcagccttcactagttggagaaagggtacagaaatattgtcagagtgggaggaaatcttagcaaacagttaatacacatcttgcccaaagagatgcatatgaatacatatagccctgttaaatgcttacataaccaatgtttatttgagcacctccatgtataaagaacttaatacttcatgaatcagttgcattccatttttgtatgtttaactaataaaatgttccctttctttggtattgtcttaaaatctagcttcctgttgcttccatctattgattttagttatcccctttgaagtcaaatagtaaaactaaaataattattccatgtgagagcccttaaatatttaaagacatatgtcatatcttggctaagagttatttcctcattaaaacaaaataactaccaacattatttttcttttaagatataaaataaaataaatctatgtagatagtggtcagattctgccaatgaaatcataatgatctacttttcatgtatttaactttgagaaaacctggctatgggtgctaggcaattaccaaatcaaaggttgttatggtgaggaaagtctgaataaatgtttaaatcccaataacttatccctgatcttccctcctcccctcaagatggcaaccttaaaccaaaggagaaaatgcaaagattttgatgctaattaggtatgtgaggtttacctcctccttctccgatggtttgtaaggccattccagatacatcaggattgtaaccctaagtgtcccacgccctacatcaggaaatgaattacctatatttcagatacatatgcaggatacttctactttctatatctttacttatagggagctgtgatcccaaaccctactaaaggcatcccagaccacagcagaggtactctaaaaaaattagctggtaatggaaggaacaataacaatacattataccctaactgtaattgaaatctactctgtctctagagaatattgtcagatacctagccaagaatgggattttattttctaattgtgtaaatgttcctattttttttgtatatcatagtatttgtaattagtaataagtcactacgacataaggattctgcaaccatcacttggattattcctcaatatttaaattcagagacacagcaggcctggtagaactaatcaccttttcatccattcagaagcagatgagtatctcctactctgagcctggtgccatggtgagcactgggaatagagataaaagaaagtcaaatcatatggaaatggaaataatgcaatagtgagagacgaaaagaagaaaccagattactataaaatagtctaagtaatcagttaggatatcctggactcagtgctgtaggggcacaaaaatggaggtgtgtatatatatatatatatatatatatatatatatatatatatatatgtgtacatatataagtacacatgtatctatacagatacatatatacatatatgtatctatacagatacatatatgtatagatacatatatatgtgtatagatacatatatacatgtacatatacacgtgtatatatatacatgtgtatgtatatatgtacatatatatatacatgttcagggtcggagaaaaggatagtaaggcaagggttctagagaaggtaatagctaagctgagccttaaagggcaaaaaaagcatatgaggcatagtctagaccacaatctaactggggaagcaagaaataaaatattaatgcaaaagggttgaattggataagcagactaaatactgtaagcaaggaaaataagaaacaagaagctacatttaagaagcagctgcttctctgtatttcgaactatgtatgaggtttaaatagtcaaaggacagaaggcaaattatgcttcctttaattctctcttatagtccccaattttattccttcatgacactcttcacaagtgagtaataacttattaaaaactgtccccccttctaagctgtaaattacagaggatagggaccaagtatgtttttttctccattgcattgctgccattaattgagtagttctcaccaccaagcacctgtttagttaatatttgttaaatagttgaagaattagattaatgaattgaatttcataagatgctagaaaagtaagatgttttataagatattcatggtttggtttagtgatgatgccatgtaaattaaaaataaaatttggaaggagcaactagaattaaggaagggcaaatcagagggtaggaaaagattactattagcatttccagcaaaatttagagcttgtattgtcttgatgttttagtataaaagtggtattatgaaaaaagtatattaaaggattaactgggttctgtgagccaaaaaaactagaggaggagtgaatagctaggtgaatagctaggcagctggtgtctcactcattctggttggaaagggatgaaacctattctaaagtgttttcagtaggtgtgggaagggaagaaaagaatagctatcaaggaatcaattgtttgtgaataggatggcatagaccttatttggcaagaaagaacagctacataatttgctgtgtctggggaaaaatagattgcagggccccttgtttaaagagtatgaataatctcaagactgtgacacaagaggctaaaataagggtggggtccttctaagtatgtggccctttgcaaccagacaggttgtatatccatgaagctggccggttgtcaggaatctcatataaagaaaggaggaaagaagaaagcaaagaaaggatgaatgaagggaggaagaaaaaataaaaggtttagggatgtttatttcagcatatactgaagttgtgtgacatagatatacatatattaaaaataacctttaattgtatggtgtatcatatctcctaagtttaatatgtgatcccaatgggtcattactatcttcaatgcacagtacatgttattagtttattgttttgtagagaagggaactagacaacatgtttggaccagtgtatcagtaaggctatgcttatagacaaaactgatcctctctctctcttaaaattaggtcttataattttaagctacataatagaaacaatgtccaagcaaggcaggtaagtatcccattaatctgctgaatatttctcagtgcagaaccactacgtctatgtattaatacttagaaatgggtaaaacacacaagaacactataccttgtcaagaggaggagactaattcaggtatttagatgtttgaaaaatgtcttatataaagaaaagctaaaaaaaattgacaatatttaacaaagaaaaaggaaggaaatatgggacaaatagtgcctgcatttattgaaggattactcagagaatctaaaatcatttgagctaccctaataggtgtcataaaaaacaaggaggaacgttataggaatgaacattttacttctgtattaggaaaaccttctgccagtatgaggtcaaaaaagaaaatggcctattcacaacaattttatttttacctgtgtaaagaaaaattgtgaaatattttgaaatagaccaaaagaaaacacaaaaacaaaacaaaacaaaacaaaagccactggctatcctgtgtgatgcagccttttgggtatctcaagcttttattgtctttgagatattttgtaactacgtaaattaaaaaaactgaaaataatgcaaatcacttttgtctattgcagtgcaaatttgtggtgtctaaattatgattgccctataactccttttggatgtacgtgtaaattctttttagcattctagatttgcctagaatgtgtggttctttgagagtcactttgaatcaattataatatcttactggtgacttcagtaattctggagttaaataaaatttttgagatgtgcatttgttctatatttgtatgagagtcttgattttacctttaaaaacctttatcttttaatacttgcaagtgtgcaattaaagcaagttattttaacatctatcagaaacattctgaaagagattcctgaatttgtagcagactgcactaaaatattctcaaaggcaccttttaactctgataatgtccaatatatgaagaaaaggaattaacagaaagaataaattgttctaattgaatgacttggcgaagggaggcaccattgaaagccacaaatacagttctacggtgctgcattggaagttgtctgtaagtgaattcagacttactgagaccaaagtgatagagggatagtcatgggaaaatatactggagtaacagaattcaggctgaattctggatgacaaaatcagggatctgacttagaagtcattgacagagagaagcattgaaattatcactatgacaattatgccaagaaaaaggaagggaaaaatcagcaaagagataacatctgtttttttgtgaaatcctcagaatgtggctattgttggagaagagaagagtatttattctttgacacaagtttccatcttggtaactatggatcatggatgtctcatttttttctctgtaacaatgcaagagaacaaacaacatatataagatatctcgtttggttattttaagtattccatcatagaaagtattgacttaccttttaatttctcattttattctcacaagttttcttagacaaaacagaaattatcattgattggttggagttttaaaagacctggataattttgttaaggttgatcatcactattatgcacaaataatttaaacaggtactttggcttcttgagaatggagctctcagtaattttgttcatagttgtttgtattccaagaactcctgaatccaaccccatgattgaattcaacatcattgtaaggcacgtgcttataagaaagctgcatatttaatcttctatttctttgaaagaggtgaaagtataattctagcaagacaaatatgcaggcctaattgataatttttatttctatatagagattcaacaagagctaaggtgtcatagaggaaagtcactgaaagagctgactagcacataaaatattttttttggtgtttgaagcgagaaaggaagaaacaacaatctatgattagagtgccccttagtttcatttcaaagagcatgaggctctcatggctgtatgaggcctccactaaaataagatgaatgggaaggaaaaacttatgagtttattgaaattgcaatattacaatttgccaagagttctgatctatgatgtccagtggttttccaactccttggactccttctaaaatgctgcattgcatatattcattctgcaatttaaataatgtgtgtgtgtgtgtttgtgtgtgtgtgtgtgtgtgtgtgtgtttcttaacagagtgaaaaaaaaaagtcctgctactccatagataccagggcaaggagcagagtgtttgtgtacacacattggactgtaaaaatcaagaataaaattcttaacttatgctgccacttctgggctgaatgcccattgctggttaaatttaccctaaaattgcaggaattaaaaatgtgatccgtttattatctctgaaagagcaaagacagagtgggaacctccgagtggttttgtggtcggagtgctctgctcttctgctgacagcctgtcagtgccctgttcctttctcatccttaattagaattctcggattctgaggttgccgtctgtaccacatttgccactgtggtccccggacctggcacaaacacggctcacctcgtcctcataaaatgactcattaccttctccagctgttatctattagcactgcagattttgcaccaatttccatgccaagtcatctctcccaccctccttattgccccacaacctactggagccagctggtgagaattcccacaccttgtttaagaggacattttcttgacacatcaagacagatgcatgcccttaagtgcacctataccaagacctgaaacaggataatttgtccagttctcagtcacagatattttgaaaaatctagttccatagcagcattaatgccatgtcaacatttgagacaaatagtgcaagaattgtctgttactgagtgagccattactcaggctgttctcatctgaagaatctttgcatttagtgtgttcaagctaaaacaggaatcatttgtgttcaaaattacttctgaacacctaccagccaacataatttgcttacttagtataccttggggcctgcatgtatgtaggaaatggagctaggaaatgagacttgtgaacaagctgaaagggaaaaaaaacaggttaccttgaaagatacaataccaaatttcttgtaatttaaaataactcctcaacagcaacaatgtaaagaaagacagttgctgtgttctgtgaaggaagctgtgctctcagatttatatgttccaactcatggcatcctgagttacaccatatgttaggatattattatagagtttagagatatagaaataaacaattcaatatttttgaaatgagctattggccaaaagtacaaaatcttttaatgaacaacaacaaaagcaaccaacgacaaataagggagaatagcataatagttatgaccaaaggttttgggctggaaaaatacatctgcttaatttcataacacttttgagcaattcttaacttttatgagaacaataataatatgcagggctggtgggtagatgatataagatgtaaaattctcagggcaatacttggctctatagtaagtctttggtaaatagaaaccagcattagaaattataatggggaggagggatgaaggtaggagggaagagagagtaaaacatagtcaataatcaatcaatcagaacagagcagaatggcttaatttgatctcaggaagaaaaatgctgctcagagataaagataatttaaaaattacatgcaacaaaaaattgatggaagcgtctacatgaaaatttaaaacttctgcacataagaacaaaccacatttcttaatccatgtgttaaatgtggcacaatggaagtatactgtctcagggtttccttcaatttggaatattaatatttagaatcaacatttggcacattccatttggaatattatgttggtgcaaaagtaactgtggttttggtcatgaaaagtaatggcaaaaaccacaattactttttttaaaaaaatttattatactttttatactttaagttctgggatacgtgtgcagaatgtgcaggtttgttacataggtatacatgtgccatggtgatttactgcacccatcaacctgtcatctaggttttaagtcccacatacattagctatttgtcctaatgctatccctacccttgcaccccaaccctctgacaggccccagtgtgtgatgttcccctccctgtgtccatgtgttctcactgttcaactcccactaatgagtgagaacatgagatgtttggttttctgttcctgtgatagtttgctgagaatgatggtttccagctccgtccatgtccctgcacaggacatgaactcattcttttttatggctaaatagtattccacggtatatatgtgccacattttctttatccagtctatcattgatgggcatttgggtgggttccaagtctttgctactatgaatagtgctacagtaaacatgagtatgcatgtgtctttatagtagaatgatttataatcctttgggtatacacccagtaatgggattgctgggtcaaatagtatttctggttccagatccttgaggaatgccacactgtcttccacaacgcttgaactaatttacactcctaccaacagtgtaagagcattcctatttctcctcttcttctccagcatccagtttcctgactttttaatgacagcccttctaattggcatgatacggtatctcactatagtttatgcaagcaataaacatatgaaaaaaaagctcatcatcactggtcattagagaattgcaattacttttgcacaaacctaaatagtaccatctagtccctgaaaaaatatttattgacaatctaccgtgtgctgacttctctgttcagcctcaatcctatcctaggtagtggaaaactgagaatccccaggagcatgtgagaaattaaacagagcagcttcaggggccacttgaaatctcctgctttccagagcaacttgtgttgaagcacagagaaagtgttgaggattgttacttcaataaatccccaaatttgcattagaagacacttagtttgtccttagcgcaaccaacgccttgtatcatggcccaactctcttaattgttcagctttcattctctgtttcttgtttaacacaatggtctgtatctcatagaattccaaacagacataggctacttttgtcttaaggcaaattggcttataattatactaattcaactaatatttatattttaccatctacaataaaaattttcaactgtttggatgaattctaatgggcaaatatttcagtacaccataattgggcttcaaaggcaatttttattaatgcttcttgtaacatacgaataaacacatttatatatatgttacaagaagtctattgactctgtaaatggtaaaatctgttaacactgcatttttatttctgctgttgcttttaggagttgatctccataacctggaataaagatattgtctttcttaacttggcatgttgctaaagtcatagtcaaatcaaattgtgtgtgcactgttttgaaacccccctccctatctccatctacctttcctggagaggaaaaaataaaaacaaaaaagaacaaaaacaaagcttgcctccacctggctttgagccagggaagaagaagaaagaagcttttgttattgatgctatttataaccctgaattactccgttagaataatggggcctgagcaggggaaggtcttttgtttgcttagtacaaatgcgtcttccccctcagtaaaaccttacttaggatcatactaaacagtcactgcaggtaccaggtgtggagctaaaagcgaggaaaggaccaagatatttgtaaagaagaaatggagaggaactgagttccaggcagaagatttggaagcggaaaccatcctccgaggagatggagagccagtggaggatgggttactttctatctgaagcctgtggagattgagaagaaaataagtgtttcaaggggttttgtcaagtgaaacatcatgggggtggtggtggtgaatgtgaagtcgtcccacctacaatacctttgataaaatattgttcattgatatggtttggctgtgtccccactcaaatctcatcttgaattgtagctcccataattctcacatgttgtgggagggacctggtgggagataattgcatcatgggggtcgtttcccccatactgtttttgtggtagtgaataagtctcagaagacctgatggttttataaggggaaaccactttcacttggttctcttttctctcttgtctgccgcgatgtaagacgtgcttttcaccttcggccatgatcatgaggcctccccagacacatgcaactataagtctattaaatctctttttctttataaattatccagtctcgggtatgtctttatcagcagtgtgaaaatggactaatacacccatgaatatcttcacacaatgttctagaaagaagtttcttcctgtttcaaaattagcataggatgaaagccaggcttgtctcagaaagctgaggggagggccacatcaccaaattctgccatcaaagccactttccttcagttcattggctttcccaaggtatgaaagaaaagtgttttctttgattggtccttttattatctacagctcccttggagcctaggtctactgtattcattcaaaaagagttggcagattggggatgacccaaaattacaggatttaggacattttcttaaaatatactaccatgctgtttttactgctttaacagcaaagcatccagacaatgcaggtttttaggatattgtgtttttccagagaaatcaaatgaattaggtccccagtggtaaatataaaaagaaaaagaggacttgttcgatttatagcaaaacatatatttagctataaaggagagaaagaaaaagacaacagaagagaaaagaaaaaatgcattttaagagagtaataaataattatgaactgttgattcagttgggagggtaaattatttcggtacgtctgaaaaattcagaaagctgtaaaatcactagtcagcatgccactgactattctggattaaagcagcaccggttaccattaaatgaaaggagagaacacggaagaatgtaatactgtgttttatgcataaacagtgttgcaagtacttactacatgcaacaattttgtaagattgattttatacccattttagcattggggataattgagtttcaaaaaggttaatcagctagaccagcttgtatagagaacatgcattttaagttaactgaagaatagttgaactcttagtctttgccaggctgtatacaagatcaaggtcagaaaactttgtaaagcatcagatagtacatattttaggctttgcaagtcatacagtctctgatgcaatactcaaccctgcagttgtagtacaaaactagctataggagatatgtaaaaaatgagagtggttgtgtgccaataaaactttatttacaaaaccaggcaggcagcagactggatttggcctggggtttatcaactcctatgattgatgatgagggtatgatggtgagaaagtcaactcattaatccctcacagagcctctctaattctaaagacactatttcaccgttttcttgcatctgctttatttagacagtgcttccccccaaaaagatctgagatttttaagctaaaaatgtttaactaagaaaagtaaatatttgcaagatctacacatgagcaccctggttcttttgcattcatgcaccagtggggtctcccaactcatccaatttacgaattttcagtttgtctccatgtctttccacagtttccaattccaagtgcaaatatcctcctagctgatttcccattaaacagagccacattatgactcctggaagacacatcaggttaggattattagacttatcttcagggaacagacatctcagaacatatcagaatttatgaagttgatgcatttgattaactgtatcatcgctgcagtcctacagctggattattgttttgctgtcaacattcgtcagatcttgatttgagcatccttgcaacactattcctcctctgttcagttagctcctgtgtggagacagggacccttcgggaaatgttctactgcctcctatgttctgctttgaatcctcctcccctgtttcacatgttaaaacaaataatacattttgaatattaatacacatttttgaaaattatttttcagtctgtacaaccttttgattctggttacttccctgtcttagaaagggaatcaataaccaagagtgtttttaaaataaagtttctattataataattatgatttactatttttatagtactataatttcagaatttccttaaagaaattaatttcgaagttcacaactttcccctcaaaatgcaaattgtaacaaaaataagaaagaaaaaaatgataactaccatgtattacgtacttaataggtgccacagactgtgttaagtaccataaatggattgacttttttacatgcaaacataaaattataaaattagaggtaagcttgagagcaaaataataccacagtaagtaattcaagtgacagtgctgtcctttgttgcttctactacaaagtgaattatagggtttggcttttactagttcagatctgtattttaggtgtgagttcaataattgttctgagcagagttgctctggccaagctgactgctgtattctgtgttaactttcctggtttacctaccaaaggtgaaatgctctggatgccagaagaattgagtttaagaagccaggatttggagataacctataaatattggaggcaggcccaaaggaagttgtagggagtactaaatataagacttgacgacaatagagacacagccctattctcagggattttgattcactagatctgggtaggattcagtaataaatatcattttcaacaaaaatcctcagcgattctgctgcaggtggtcctcagatcacatcttaagaagtattgatgtaaacagaactgtttcaaactgcttctttcttcattcccttactccctctgctaaccaagtcctcccactcagtccactgaaagggccaggcttggtgatgctaaggtatggcttcctccctaaaggagataaacaatacaaaaactttcatgctgagccaaaatgttcacttaatatcaacttgtaacagtctcttgtattttgtgtctagatccttgatccaaaactacctaaatttggaatgaagctgctcaaactttcataattactgacattattaagattttaaatctgtatagaactaaagttttacttttttaattgatgcataatagatgtacatattttgggggtacacgtgctagtttgacacattcatataatgtataaattggtgtaattgggctattcatcaccttatttactttttatttgagaaatattcaaattattctcttctagctattttgaaatgtacaatagattagcgtaaactatagtcatcctactgatcagttgaataccagttatcatttctcctatctaactgtgtatacttgtacccactaatcaacttctcttaaagttcttcttattttccagccatgcctagaatcttgacctagtactggtaaacactcatgctctgcatgtgtttacaacactttcgatttccccatggttgtgagctgttcctctgaattgacacttggatagatgtcctccaatacccatgttgtatttcatttccatcatgaatacttgtgtatgagctccttgctacatctataaaattggatttccagccttgccttatctatccttgctcaggtacctgctaatagacatctcctcttgcaaatcccacaaagacaccaaatccaatatcaccaacacaaacctgatccccttttgtcatttaaaaaaatcttactaaagaaggccatcactattccagtcactaacgttaaacaaacaaaacaaaaaactgggtgtcatcctagatccctttatgcttaccacacatcccttcatttaatcccccaaccgttttcacaggcaccagtgtcctagggttctatctgggcttcctagcaccaatctccctcctctcaattccttcttcacattgctgcagtccaaactatcatcaaaccaaatctgattatgccattgcttttcttttctccttaaaacactttaatgttttcacattgccaaaagaatcaatttcaacatccatgcaattaaaaagtgcatttataacccagagactgtcaatttaccccaactaatctccatctcattccatgtatataatcaaaattaatatatatccagctataataagtacttacagtgtcccaaatatgctgttctgcttctggcctcgaccactccaacttaaatcaccatcatgttttttctgcacctctgtaagagactctcctttcccctttctcttcccctaaacatgtcctccacccaaccccctaagtgaattttgataaaataataagatcatgtcagtcctctatttggctctccaatggcttcctgctgcactggatggatgttcatattccatccattggtctataaggtcctctatgatctgattcctgcctaccctctgccccttctctccttccatcctcccactctttcaaatcactccaacccaactgaccttcctgatcctcacatgagccaagctcatttctgctttaggaactttgctctcagaaccttcctgtagcttttcctccatgcttatgcatggctggttcttactccttattcaggtctcaactgtcacctcctcggagaagctctccttgaccacaccatcaaacgctaagtgtcctccccatatttctctgttactttactgtgctttattttcttcacgccatttctcacttagcaaaatcacctgaattagttagtttactaatatagtcatgcccctccccaacgcaattgtaaggacaccatttcaataagcatttgttgaatgtctcaatggctttgcttatgttgttccttctgcttcaaataggcttcttcaaccttgggcactgactacttgctaggctctagaatattcttcaacacttaattcaaacaactcttctgctgggaagtcctctttcaccccaaacagcattgatcacatctaggtttgccttgctccatgtctcattacagcatcaaactgtttcataactatttgcttgcatgtccttctcccaaattagacctccttggagtaaaggatgaatcttattcatctcaggatcctctgcatataacacggttctccaggggcagtagatactcaataaatgtatcctgaatgaacaaataaatctgctgctgcccataccagagtgtagataagatgtgagaacagtgatgatcagagtgatggagccttaagactaataaataagctgaactcaagtctctcattgtatgtgtgtgtgttgacttttcacatgtatagaaagatacacacacataaggtatgaataatcctcaagtacaatgattcaaagaaattacatataattaatccttattatattgctcagaatgtattttaaatatatttggtcatttatggctaatgcaacaattgtagctgcaactgtagctgtgggtactcatctttttgatttacgtatgcctgtaactgtacttacctaaattgataggttcagaataaagaaggaagagtatgaagcaattcaaatataatgcttagttcaagggaggtactttaaatctcttcttaattaaagaaataaagattcttggaaaccaatcattgaatttgaattttgccatttaaaattttatgaaacactaatgaataagatataatgtccatgtttatatacattcctataaatgttaagtatttgcttgcatctacatatctattcagctttgattattcctttttggcagttttatccaatatattgttttttggaaaaaacaacttttaacaatacttacaagactcatgattatttctctcttctgttgattttgccaaagagctttaaaacatcttttatcactccttcattacatggatgaataaacttatttgagcatttatttactaactttgcagttgctctagttttctaaattttgtgttttgaatcctcttctgtgtctgtaaaatgaccttggagtgaagttgtatctgcaagtcacataaagccataagagatcatagagatcactaaaatttattcagactttttgagtatttgcaagattgtgtgggaaagaaaaagaggaggaagaggagaaagaagaaagaaaggaaagaaaggatgaagggaaggaaatagagaaagaatgtaagacttcaaatgcaaagaagaaagtgcaaaatccagtcaaatgttttggctggttgagaaatgaaagcaggtaagatattacattttattaactaagaggccaactacttttgaatattttgaagcccacaatatctgcagctccaggtaccttgccggctaagctaaaatcacggggtccaacttctgttatttggaaaggcaattgcctgagtggccatgaatcttccaatcttaagacaattaaaagtaagtagcaatgataaaaaaaaaaatccagttaaatgaatgctaatgacctgtctgactagcgatgtgtctttcaatcccagatgaaaaatcacaaacaaaaagatttaacaaaatcaaaactataatatctgaaattatagaattggattctcatgtctaaggatttgcacatttaggcaatttatgtttctgagatgcttaaacaaatttaatctagtagactgatagtcttatagtttaaaatatattttaatcaaaatataatgaagtaactgatagacttgtgattttaagttgaaattttagtagacttctgttcggtaatgggaaatctaagatttttttcattcgtcgattataaattttaggttttacttttataaaaattatttagtgaataggaaagtttgattaagttagagagttacctcaaaatgaagtaaaatatattaatttttgaataatataccttctattactacatataatagtgctaatgaaatggtagtatctattgttgcaatgcagatgtggagtcatttgcttaaagcccattaaattgtttagaaacctaagagtaacagatgaatgcctactttttgctgtgtctaaatcatcctacgtgttagttgctcttgctatccatttatagataaagaaactctagaacaaggggtaaaggaatttaagtaatctgaccatgtttgctcagctagtaattttaggaaccagaatttttacctagggttgtgtgatttcagtataaaagacttattaaacattgtaatacagcaatatacagtaataccacctctatcttgtttaacacgatatattttgctcctcaaatggcaagcataaatgggaccttggcaaattgcaggattatttgctattggaaatttttgtctaagagtgaaaaataaccctcattaatcttttatttccatacagagtttcatagattgtctatatttaagataaagccaacttttacacggactacctctgaaaaatataaattggatgctatttgtctgaagaagttaggatgagatttgatatcctttttttggtacactaaatttagacaaattcaagcaattcttttgaaaatcactgtgggacaaagatattgaaagacaaactagaaaagtaaagtagctagtggaacatctttatcactttgatcaattatttcaaaagcctccaagaggtcagattacttcgctttaggtttccaaatgtattaggacattttcagtgtaaatggacagttagtctagtgaaagtgttgttcctctggcattttctgaactttaaaggacactggggtgtttctgggagtaaaacagcaagtcttctttggtgggattcttgcgggctggtcactaaaatgcaagtgtggtccacgttgaaatgagtaaaactattgacctatggctcagaagctaagagaccaaggatgacataaacatgaacactagctgttccaagggacaatgccatctggtttgctgtagacgctgtcagaaatagcagactcctgagattctcattttcactcttggcagattggaaaaggctaacaaacactatggcacaaaggtaaataaactttccttggaggctataggcttctcctcaaagtcaatgaggcaaggcaagtacatttttaaagtgagtccttattgaggatcattggatgcttcattcttgtgccttgctctgtcataaagcttctagggcgagaccaatatgcccaatctcaaacattctatttttaatattcctttttacaattttttttttgagacggagtctcactctgtcgcccaggctggagtgcagtggcgtgatctcggctcattgcaacctttgtctcccaggttcaagcgattctcctgcctcagcctccagagtagctggtactacaggtgcccgccaccacacccagctaatttttgtatttttagtagagatggggtttcaccatgttggccaggctggtctcgaattcctgacctcaggtgatcgcctacctcggcctcccaaagtgctgggattacaggcgtgatccactgtgcctggcgtacaatggttattttattgactaaaactaaattagttttcacatgtaaacaaagatagttaaccattccctgaccaccatcaaaaaaatggggtgggaggaggagttagtggctctgagtagacgcaagttgagggagtcttcttccagacagaaaaaaaccatcctctgttgtcttagaaatggtggccaataggtttccttccttctgttgttttctctttggacaggaaaaatatgtagaaagaatgagaaatgccctaagcattaaattcagtaccctgaacaatcttactggggagttgaacccatgcctggatagccagagaaagaattatattatttggaggggagcttggggtggtggccatccagatatgggaactcagagaaaggatatttctggcaatggcagcttcataatttctaaatagtgataatttgatcagagagtgaaggtggtggtggctggtaggataataacattgagactcgatatgtatggcaaacaggatcctttttaacatatcactgaggatggatggagaggaagagagttatctttctgagaatccctgatatgatctgggaacagtagtcagcagagtcattacttttctattgctgctgtaccgaattaccacaaacttagtggcttccaaaattgcgaatgtattaccttttagctctagaggtcagaagtctgatgtgggtctcagtggactgaaatcaaggtgtcagcagggctgtgttgctttcccagtgctctagggaggagttagtttctgtgctgttttgtttgtttgtttgtttgttgtttgttgtttgtttttgagacagagtcttgctctgttacccaggctggagtgcaatggcaccatttcggctcactgcaacctctgcctcccgggttcaatcgattctcctgcctcagcctcccgagtagctgggataacaggagcgcatcactacatccagctaatttttgtatttttagtagagatggggtttcacatgctggccaagctggtcacaaattcctgacgttagtttttactctgcctgcattctttggcttgtgcatgccttccatgttgaaagccatcaatggtgaattgagttctcaaatcgtattactccaatcttccctctgactcactcttccactccttaggacccttgtgatttcatgggttcctcacatataactcaggaaaatctgcctatcttaatgtcagctaattagcaacctttttttttttttataatgtagcaaaatatattagtagggtccatgaattaagatgtggccaccttggggtgctttcattctgtctgtcacaacagctgtgaaaaacatggtgtctggagccatattgtctagattcaatcccaatgccaccacatactaactatgcaactctggactaatgacacagtctctccacgcctcagtttcctcaactgtaaaccacagtgaataacgcctatctcagaaggttcttctaaggaataatgtgttaatatatgaaatgtgcttacaacagcacaagtactcaattaaaatgaacaattctgatgtccacctactttatcaagatagaagataaaattattaaacatatggcgaatgcctacaagcttcagacttaggagaatttgattgcagctatcaacaatagacacttacaagtgcttcctaacatgtctacactccaaattcccaaagtgaatgaatggctcaggagatcccagaatcaaatcaggtggacactattagaaagcacccgatttgatcccgggatctccccagccattcattcactctgggactccgggaatccttgcatggggagagcttctcacatataagcataatgtttatctgtagctctgccagttttcttagtcctgttcctttgaagtctagcattaagtaggcctaagatgtcatgcaagccactgtccatgatactgctggtctctccaacttgcatctgcctccctttctcacaggtcacagaaaaacctatgcttaccctgaatttttcagaacatagtcacatagcacagctggtggactctctagtaacaaagctatttccattgttccacaatcatctgcttcacaagagacaacaggctcctgagaactggggagctgagacgctgcaggtgacagttgtatacagacgtgcaaagttcttgggatctcttccaggttctaattcaggcccggatgctaaggcttgccctgctctgcaaggcttttactcatggtgcttttctcttaaaggctttattgttttgttttttcatgatggtccttattacagacatttccctctctactctacattccctttctattccctctgtattcttccacaactaattaccacaaccttagaagcttaaagaaacacaaatttattgtctgacattttctataggtcagaagtccagtggtcactgccacgtctttatttagaatctcacaagcctgatataaaggtgtctgcggggctgccttactttctgaaacctctagaggaatgtctctgttcttgctcattcaggctgctggctgagcttagttccttgtgctgtgcaactgagatccacatttccttgatgtcagctaaggaccattcttagattctagaaattacctgcattccttggcttgtgtctccttcctccattttcaaaggcatcaatggtggccgagtccttcttacatcaaacttctctgactcttctgtgttcctcttctgtttttgagaatccatgtgattacattggggcctccaggataatctccccatatcgaggtccatagcctttatcacatctgccaggtctttttttgccatgtaatataacataaaatagtcacagaatctagagattaaggtgtaagcatcattgtagaacattagtcagtcaagcactgcctcttgtactccagtcatcagggtcattagatctacatatgtctgaaatttttgcttctaattttctcccacagactccgagttctcaaagaaaatcaaggcatatggctgggcatctcttttagcatccttgaacagtctgtaatggcccaaatgtacttcaagaatgcagcaattgaaaacaagtcacccggagcacacagactagaggtaggtggtgcttcctcacagccaaaatgttgcctcatcactgaccagccaaaggtgatccatttcatccatattaagagatactgaaaatactaggagaactgatgagagataaactgactttcctgggagaatttagtaaaagtcctccaagagattatgttcaatttgaaatttgaagtatgcaggaagtttaataggaagaacaggaatggataggagaaatcatttcaagtaaatagaaaagcaagaatatgcttgtgaataatgagaaaaataaattttgaataaaattatgggtgtgtgtttgtgtatctattgtatgtatgtgtgtttgaataaggcatactgatattatgtattggtcaaccacaatataggaaaataaattgaagggcatctctttaaatcttacaggtagtccatgctttccacagtaccagcattatgttaaatgaattcattcatagtgatcaattcctcacttcgcatgagttacagttaatatggttctgtgcaaaacaaggacagcctgtatgtctatttttaatcaaagatctgaattgctgactacagggcatactcattaattcagacacctctgaagatagaaaaatttgctaggactagatttgaaggggatctttaaaaattagagcaacaagtaatcacaatgaagatgatatttcttaacaagatatcctcatggaaaatagagaaaagagaagaagattgcttccttaaattagggacacagactagtgaggtaaaagaaaagcagaaaaataatctgtgagttatacttgactacaaactgataggagagcaagaacatgtagcgagcaccctactatgtgctaagactgtgttaatctaagtacttttgtggttatcacatttaatactcacaaatgtttgtaagatatattttattaggtgaatgtcttgatgctgctgaagatcgaatactatctgaattgaaatattatctcattactactattcctcatgccacaccaggaatattcttgtcatacctactctgatattctggaaacaggcagaaactgttatatttaggagatacttctcctgctaccttagggatacttctcctgctgtctttagattataaaaccattttgactatgaactacttttcagtggcaggttataacaggtcatgcccttcgggcaatttataagcttgctatggctactgtaacaaaacactacagagtgaatggataaaccagcagaaatttattttcacacagttctggaggctagacatccaaaatcaagatgtcagtggggtaggttacttctgcagactatgaggaatgatctattctagacctttctccttggcttgaagatggctaatcttcaccctttgtcttcacattgtcttccttctttacatgtctgtatccaaatttcatctccttatgaggacagcagtgatattggcttagggtccacactaatgacctcattttaatttaactctgtaagtcccattaaacaaatatagtttcatttgaggtactggaacgtattataatctttctttttgtgagggaggatgacacaatttagcccataacacagaagaaaaacacaatcaaaattcacattagggattttagctctaagaaattaaatatgtatattagaatacataaaaacaccaataagaatacgaagtcatttgtgtaaatgagtttattcatacattttcatactgctacaaagaaaaacccgagactgggtaatttataaaagaaagaggtttaattgactcacttttctgcatgggtggggaggcctcaggaaacttacaaacatggtgaaaagggaagaggcacatctttttttttttaattatactttaagctctggagtacatgtgcagaacgtgcaggtttgctacataggtatatatgtgccacggtgatttgctgcacccatcaactcatcatctacattagatatttctcctaatgctatccctcccctagacccccaccccctgacaggccccagtgtgtgatgttctcctccctgtgtccatgtgttctcattgttcacctcccacttatgagtgagaacatgtggtgtttggttttctgttcttttgttagtttgctgagaatgatagtttccagcttcttccatgtccctacaaaggacatgaactcatccttttttatggctgcatagtattccatggtgtatatgtgtcacattttctttatccagtctaccattgatgggcatttgggttggttccaagactttgctattgtgaacagtgctgcaataaacattatgtgtgcatgtgtctttatattagatgacagcaggtgagagagagaagaagaggagtgaagggagaagagccccttataaaaccatcagatcttatgagaactcactcaccatctcaagaacagcatgggggaagccacctccatgatccaatcacctcccatcaagtctctccctagatacatggggattatggagattacaattcagtatgagatttgggtggggacacagccaaatcatatcagtgagcaattaaggaattaacagtgtcgaatcttggtttgttaacattgatgaagacaaatatatagccaccaatatccactctatctcttcacctggtttaaggtttttttgtttgtttgtttgtttgtttttgtttttgtttttttcctttcatcatggcaagaggtgctttaactcttcattctgtaatcccatgaacagctatacagatgtaccatacattttttggaggggtgggggataacattcttcaatgtcactaggtttttgtaggaccaactcaagccggcaggtatagttagagagacggaaaggtacaagaccaactatggaagaatccaatgcctccaagcattacatgttaggataaagatcaggatcactgtttgcattctcagtaagataaacttagagaaactgcatgttttcccttttctcaatgatttaactttttcttagttacgagacaaactttagaacagccaataatccattagagtgaagacataattgtctttttaataacaatgcctcaaagtgtgggatatacgcctgtcaactcagagttagaattgaatgtttgactttcattttatttatgttgtagaaaaaaagattgattttttttaaaaaaaggaggtttttctgttttatttcattttaggctgaaattggttgtcagaatacagcatcactgaaatattatgtgcattgaacaaatggagctgggttgcattccacagtatgccaccaaagtgaaaagaaacaaagtttttgtatagaaaactggcatgttaataacgtcacactcagtggcacatgcctgtagtccaatatactcaggaggctgaggcttggaaatcacttgagcccagaagtttgaaactagtctgggtaacatagcaagaatccatctcaaaagaaattgcactgactggggctgaaccctcaagtcattgaatcatggaattttaaaggagaagtctggctttttcagttgtctggagtggatacttaatttaattaaagagatggaatgcatttgatgaaaacaattaagccacattggcatactctacattggcatctaatatgatacggctatttaataaaaagctagtattctgtttgacagatcaattattcattaaatagatggggcagaaatggacacgcaaaatcaaagctgattaattcagcaaaatcttcaataatactgtcacctttaatccaagccaatggcttccagcacagcaggcagcttgatagagggtaaagtaatcacaatgcaatgtgttaagtgcaagttataagaagcactatgtaaagagtactatgcaaaaacagaggagttgcaccctgacttggggatatcagaaaaatcttccttttaatagaagtaatatcattcttagttttaatagatgtcaggcaaagaatgcataagtaggccgttcaaaggtatgtagagagaaaaaggccctgttcatattctgagaccctggtttcatcagtctaatcttgagtactgttggatcagcagccactccaccaagttggaacatgagggagtaattgatatttctcccataatccagtgtattcattatggtatactgttgcaatcatgctcccaacatgagccagcctcctacacccatgcccttggacagcctactaccacattcaatagggctgatatgtgttaaccaataggacattgtagaaatggcaccatgtgtcatcagaggctgggttatcaaagaaattttagcttctgccttgtttgttctcttggttcagtctctgtgggccaccatgcatgaggacattcaagcagccttatggagcagtttacatggagaaaaactaaggcctcctgccaacagccagcaccaactggccatataaatgaactaccttgatcatgaatgcagactctctaaagcctttacatggatgcaacctcatgagagacccctgtccagaagaacacaattaagctcctgaattcctgacccacagaagagctgtgagatactaaatgcctattgttgttttaagccactaaattttgaggtaatttattatgtggtaatagataactaagacatgagtatacactaaccctaaaataatctcaaaatcccttcatgttgtccaggtagtaccattaaatgtgacctgcatgttctcataagtgtatgtggtaagaaatgttccatgcatttatttacatgtgtctctagaaaaatattctacagggaaacaattcttctattcctcaatggatccaggtagggcccaccaacactttcatttattctggtggccaggcaagtgcaatggtccatgcctgtaagcccagcactttgggaggttgaactgggcagatcacctgaggtcaggggttcaagcagcctggccaaatggtgaaaatctgtctctactaaaaatacaaaaaaaaaaaaaattagccaggcgtggtagcatgcacctgtaatccagctatgcgggagactgaggcaaaagcttaaactcaagagatggaggttgcagtgagccgagatggtggggctgcactccagcctgggtgagaaagcgagactctatctcaaaaaaaaaaaaaaaattcttctggtcagagaaaatcaattcagcctttagctgagtagaatgagtacaaactgaaaagattattagagagtgaattttattcatgcagacaacacgctcttgacatgagggatgcaggtgtttaggcatatgctatacaaacttccagggcataaaaccaggccagaaagaattttctggtcaaacaagctcaacagcttaatagcagttccaaagctaggaaaaatgaatgcacccctaccttcactagactatttccctcctcccagctggaaagataaagggaaaataaacccttaaatattgagctatatatatataagtatttatatatataatatatatagcttaaattaagctataatatagcttctatttaatgcatattaaatcaaatatacattatatataaaataaaattacattacattaaaattatattaaattaaaattaaatatacattatagcttaaatatacacatttaagctatatatataatttaagcttatatagataaattcatatatttatggcttatatatgtataatctaaatctaaatatatatcatctaaatctcttacagacacgcattttaaaacccatcaaaaaagctgacaagtcaggaatccgttttaggacacctatgggcatattctgggaaaggagtcttaatcattgagaagcaaactctggagccatttcatggagggatcttaaaggcacacaaccattggttttactgcacatgtgtcaccgtctgaagccatcctgcaactctcacgagtcatctgctctgaagtagagcacacctatttctggaaaaagaggatcagactgtctttttctgagtgtggttggcatctatgggataggctttcctggttaaaaactagttagttaaaaactaggaagataagagtagcacaattgaaagaaagaatgaaagaaggagggagagaaaagagtgaaagtagaaaaatcaggaaaatctttcagtgatagaataaaaataaatcaaaggaaaaaagaaaaaaataatgattagagtaaaagaaactagaaataactttaaaaacatacatcatatagggccgggcgcggtggctcacgcctgtaatcctagcactttgggaggctgaggcgggcggatcacgaggtcagaagatcgagaccatcctggctaacacggtgaaaccccgtctctactaaaaatacaaaaaaaaaaaaattagctggaatggtggtgggcgcctgtaggcccagctactcaggaggctgaggcaggagaatggcgtttacctgggaggtagagcttgcagtgagccgagatcacgccactgcactccagcctgggctacagggcgagactccgcctcaaaaaaacaaaaaacaaaacaaaaaaaaacatataaaagtaacaaatattctagataccaaacaatgaaacagacaaaacctgaaaacaaagaattgaggagaaaaataaagtacatctctaaaatggaagctattcctgccccatccctaaatctgcttccatattttagatgactgcagttttattctttgagaaggcaaaagtctaggaatcattctttactcctcttgttctctcacaccccacatccaattttccaggaaatcttgttgattctatcttgaggctctttctataatgcaaccattctgcaatctctccaaggccaccactttgctctgagcaatccttgtctcttgcctgaattgtgaaaataccctatgaatttgtcctctggtttctatccatgccctttatggtctattctgaacacagaaacaaatgtgattcttttaaaggtaggtcagaccatgtcatgcctctgctttagcctccaatagctccctatttctttgagcaaaaaaacatacaaggccctacaagctctggctccccagtcactgcccttgtctcagctccttctgcccttcctcttgcatcttcatcatgctccagccttaaagctttgcacttagggtctcccattccctgaagtgttcttcctctaatgtttttccaagactgataccattatcttcttcaaattttgactcaaatcttacctttatctctccacctgtctcacaattgcacccttcaatccttcccctcccacccacctcttctgtgcatgactgatactctttattaccatctaacacatctccagactgctcttccctcttgagaatgtcagcaccaccggtgcagaagtctttgtctgaattgtttaccaatgtgttgcaattgtctacaacaggtcctgaacacatccctgtgtctctattagtgtcctggggctgtcgtaacaaattaccacaaacagagatttactttctcttcatgttagaggttatatgtctaaaatcaaggtgtcagcaggaccaaactttctctgaaatctgtggggagactccttccttgactctttctagtctctgtggtttgctggcaatccgagatttttctcggcttgtagttgtgtcattcacatctctgggcctccatagtcacatagtgttcctcttgtgtgtctctgcgtttcttcttctcttcttgtaaggacacgagtcatactgaattaacagcccatcctacttcagtatggcctcatcttaatacgtgttacatctaattaatgaattagctaattgatgaccttatttataaataagattacatcttgaagtgctgtcaggacttcaacatatctttttagagaacaaaattcaccccataacagttccccaaaatatttatttaaatgaatcaatgaaggtactaagtgatgtaagttcttaaaaacattctttggccaagggcgatgtgggaagtcccttactatagttagtacatctgagtgaatacacaaattagtaagacaaatgtagctgccttgataatgagtttataagtatttttaccaaaactgtcatttgataacaaattaaaaggttgtgtactgtgccttctttcaccatggttttacattacaaaatagagtaatttctaaaatgtaaatatcaataaatcataagaaagtaaaattcattattaaataaagttttacaaaacatactgtcatcctgtagtccctctgctatgagaatcacagagaagtgggtcattgtttcagaaaagaatatggcaataaaagtgaatttaaatattatgtcaaagaggaaaaacacctctttgtgtttttaatatgtcaatcattgctgcattttttattagaggacacgttttcctttaatttccctaatgtgttatagctttattcctaaaccacatgctaccatgattcctttgtgtaattttaagtaataaatcataaatgaatcataaacaaattatagaataattattctgctccagtgctcacaatgattttcctgctttttactttaatgtctcctattcctccttaatccaatatttatatttatgacaagcaccagttttcaatcaagagaaaagcttctgtgaagttgggattagagaatgttttattccaccctctattgtctaaataaacatgttcagaaattaatctcctcctttttatggatctgggctgtttcaaacacccccaggcaagaagaggagatctcgcttctacttctgatcatttgttttaaactctgtctttgaaattagcaaaatcctacagggactcaaaaaggttacttgttctttcaggcctctgtgagtttgaattacctgacaggtattgagaaaattatttataaaacaaaaacttttacagaagctaaaatataagtgacagaaaggactttagaagggacatgttgtccagaattatctaaattgtaataggttgtataccactgatggtacatatgatgctgaaggtagtaacatactattcaaaaacagactttaataggaatatatttgttttacattggcatcagttcagtttgctgtggtactctaaatactcagaggtaatttttgatgctcctagtctgggtaggtaatttaatcaaattcagtataatgctagcaaaaagaaagaaacagctcttcaagcctgtgatttcatagatactactgtccggaacaatactccctttaaaaaataagtcaattgagttaaagcccatttaaataaatcaagtatataaaattgataataaggtatgtcaaaaaatatgaaggtggtagccaaaataatgaaaatttaggaaccattgatgtagcagataagcaaaatagacaaagtaatcaagtgacttttcagattgagagctacctttctagttggagagtggatcattctttcctcttggtttttgcattctctctttctccttctctctttttctggtctctctctctctctctctcactctctgtttgtatttatatattttcttttctttttctttttctttttcttttttttttttttttttttgagagagagtctcgctcagtcgcccgggctggagtgcagtggcgtgatcttggctcactgcaagctccgcctcccgggtgcacgccattctcctgcctcagcctccctagtagcttggactacaggtgcccgccaccacgccctgctaatttttttgtatttttagtagagacgggatttcaccctcttagccaggatggtctcgatcacctgacctcgtgatccgcccaccacagcctcccaaagttctgggataagagacatgagccaccgtgcccggccatatttatatattttctatattatctcatatgttcacttgtttgtttcgtctaccaaatagtgagttacttgatgatcccaggacctcatttcatttatctatgtgtaaataccaacaataccaactatacactgctcacccgataagtgagactcaatacatgtttgtggagtgattggataattaacagcaaagatagaagttagtccattggcctccgacttccctccttaagtcctcgttcagaactattttcactgtaccatgcgttcaacatttaatgcttagatattcatttccaaagtcacaaattaaaatagaaaactaatgcgctccacattttaaaaatcttgagaaattgctaatgattatcaactgaaatatttgaatgtagaaatagctttttaaaaaattagtgcttgattaagcaaatattaaacatggtggtaccactgagttaaagcaagagtaagaaagatgaatatttattatttacataagttttgatcatatccttgttgttagctgtactgcatactttagaagacatgcaatcagacagtccaaattctaattgcagctttgctcattatttctgtctggatttgttcaaatccttagaacctttggagactggaggaaaagtaacaaccccaggtaacctgttcctgaaataagccaaataaggcatagatcccaaggtgaggctccctttgttgattgtattcaccaaatatataaatttactaataactttttcattcatcatctattcagtaactaagcacctgctatgaaccaggactttagctggtatgacggatactaaaatgggtaagtcctagccactgtcttcaagtgtttcatggtctaatggaagatgcagaaggcaaaaactcagatattaaaaatcataagtgctttagtagatcacaattgcagccagaagatgacacttcaaattagaaggggtgttaccttgggattatgatttcacttctgtaagattccatcttgtctcctgtaaaatgggtatagcaatagttacttcatgaaataaagtgatgtaaagaccattgtactcaatgttttgtggaagaagtaagggtaggtaatatacaccagaaattttaggcccaaggggcagcatgactgagcacattaataattaattctggaaatccatgaatggagtcagcagtaggaattggaaagtgattgttttaaaaaagtgttaaggagagtgaagatcaaaagagtagaaaccataagtaaagaaagaattgtggccaggcgtggtggctcatgcctgtaatcccaatactttgaaaggccaaggtgggcagatcacttgagtccagagtgtgagaccagcctgggcaatgtggcaaaaccctgtctctacaaaaaatacaaaaattagctgggcatgatggcacatgtctgtagtcccagctactcaggaggctgagatggaaggatctcttgagactgggaggcagaggttgcagtgagccaagatcactcctgtctgggtaatagagcaagatgcctgcctcaaaataaaaatacgataaaataaaataagtaaaaaaatacagtaggcatagaaaaatattattagagttttaccctcctatctaaaactgtccccaaatcctgttaactgaatagaaagaaaaatagaaaatgaaaaagaaaaaatagcattgatgaaaaatagttgcaaagatttccctgaacaatcagccctagctaagtttccaactaagcccaaactgtcttattacacattctacaactcaggaggggatataagagaatcccctacttttcttgctctagtttttacagctgttgcccatgtacttagccaaggtcatgtgctcaatcatccagtcccgagttttgcttctgatgccctgtctttcagtacagccttctgacctctatctccagtctgctccaaacctccatgatgcttccccagctctgggcctggttgctgattgttgttttcctgagattctgactccagtggtttaactaacaaccttcctactttttcttcttatagagatatctcaggctccgtacagaaactcttattaaaactcacagcattaaaccagaacacagacaaatgcctacaatggatgtgaagtgagccaagcaaaaagcaataaatagggagttttgaggattgttgcaaatagtagtaatgctccaaccaaaactactcaaatttaatttaaaaaggcaaaacatcactctagtcaaatagtatatgttcacaggtcaagaggattcagtctgccacacctaaataaacacttaatgctatctagatctctccagttgaaactgcagctgcctcagaccctgaagtgtgctgttcacaggaaaatgtgtcataattttgccatcttattacttattttttcctgagatagggtcttgctctatcacccaggctggagtgacgtggtgtgaacatgcctcactgcaacctcaacctcctaggctcaagcgatggatcgtcctgcctcagcctcctaagtagttgtgaccacaggtatgcataaccacatctgatgaaatttttgtagagacagggtatcaccatgttgcccaggctgttcttgaactcctgggctcaagtaatcctcccaccttagcctcccaaagtgctggaattagaggcacgagccaccatgttcggccacttcttttttttaatagacaaaaaggcaaaaggaggttttcacaatagacaatgaggcttaagcttgttttctgagaatccaacacatttgggcacgaaggtctgaagctggtctgctagaggtacattatataaaagaaattgatatttgattcacctattgttaatactcaggaacattctgaggttggagccagtgcctttatctattgaacaatcagaaagaaaagaatgacctaagccggcataagctccctataagaacagtgaaagacacatatctaagaagaacctaaagggatcctcaccctacttcagggctgccattggcaactggcacctcaaatactgggaggccaggcaactttgcctttcaactgtgagtgctggagagctccttgctgtcactgtcttcatgctgcgaagttattgtatcctttgctcatattaaagatgtatctttagcctggaatcattggtacctttctgtcaatcactgtcaccaggtagcaactaccaggtaattattcacagatgtacaaatgatgtataattaaaaactgcttgctaaagtcttttaatgactttacccccaagatgttccttatttgatctctgggacaagaaaaaacgggcccttctgagtatgttaattgaggtcataattggctgatatgtataatcagtttttccatgtgttttctcaaccttttgcctgcctatcctgcaattccacaccaattaaaaaagaaatttattaaatatatgtgttcttctttcattgcaaaatctcttattccccagagtatttcagaaagggcaagacaaccttgctttccagctgtttgcaagcattatgcctttgagtcattatgcagagctttttacaaaatcaagacatgtattcataatatctgttaatttaacatgtttatttatatcactggagcatgacttctgcatataaagaaagacatattttaatagttaaaatttaattaaaactataaaactacataattctccatatttataatttttaaataatcagcaaaatcctgaataagaggcatcaacttaaaaaaatagtttgaaaatgatttctctcaaggaaggaggaaggagtgacctgaattttacaaatagaaactttctaagtaacacctgaattgtcagggcaggttatacttcacaaaatcaaatcaatttctgtgacttgttttttatatttcttctgccatcactcagaacttaataactgggaagatttcaaatacaataggtgaaaatatccagtcatttatattttttgtataagtatttaacattcaatatgatggagcttatgacatcacttaaatgagattaaagatgtctgagcttagccaactacaatactagcagcaaatgtccttgtgttcagtgcagtactatgatttccaattagttttttccatcggcttaatttgaaatcataatatcataaacattctgaatttgacattgtgtgtcttcattttaatagcaggaaaacagatttgtaatttttgagcactttatagatggtgaattatatcacacactgagtcaaatcttattactaaacaattatgaatttaccagctagtgactggtatcatgctacttgctagaaaaattactaaacataagatatgctttatatgaaaggagattacacctatgaggacaggaaaatgccgtattcatcttggcattcatgtttttatcctacaaagctgagctcaatattttaccaacagtaagaactcaacaaatattgaatggaatggtttctctaataaaatttctctctctctgtctctcattcacagttttttagcttatgttggttcccaaactttagcttttagttttgcataagcattacctgggagttctgccacttactactttctgccatctactactctcaaagttcttttcaattagttatagagaagcttaggaagctacagttttcagaccaccagaaataccagcttagtagttaccaatagttctttcttgttggagcatctcagaaaagcattacctgggagttctggcacttactactttctgccacctactactctcaaagttcttttcaattagttacagagaagcttaggaagctacagttttcagaccaccagaaataccagcttagtagttaccagtagttctttcttgttggagcagctaagaacaagtcaaagtatttattgagaaagagtggaatttgaataataaccttcctttctgctccatcccagtgaaagcagggtgggtgatggtgatatatatactgtatacatgcacaagaatctgtgcagaaataacatgtatccagcatccctcactccaggcagcaattagccctttcttcccttccctccccaagaggcaatgtactacaatgaatagcgcacaggacttcagatcagacagaccgaagaaacttcaaattctgcctccattacttaccaacagtgaatttgggcaagtgacttgaactcccaagtcagctttataatatatatataagaagagtaataactagctcatagggcttttgtgggaatagagaagttcatagagaattttcatagcatatattccagaattgtaactattgttttttccatttacagactctaagttaaagaaagaaactacagtattaccagtcacatatatttatacactaagtgaaaatgtcaccacaactcaaaaaaataagtgggtgtggaatagatgaccttcgaccttgattcttaacctaggatgggataattatatgattcatattgatgtatttatccatatataatttgacataggattgtctaaatgttgtcagttcaaagtagatcatctggcctgactaaaaagttatcatatttcatattttagtagatataaaatttgactctaaaatgtcagtgccaaaatcttagaaataatattcatgtttttactggagtctcagataataataaatagctctgtcaaataaaaaaggtaaaatataaaatctgaaaatgggcaatatgtttcaacaagtgaagagaaacaataaagtcaaagactctttgacgccgtaaattgaatgccaactttctatttcacttagcttctcccccacttattatgctcttacaggttttgaaagactcttaacaggtaaatgccctcataaattcttgaatatactgagattagagttccccttctgctagctccaaagttacctaattttgtgacaaagtagctgacagaatgtggcaattaagctatgttcatattagacatggctgcatctattttttttaaccaaaatgatctgaggttccaaattatgaagcacagcaaaccaacagtgcttttcagggacaaactgaatatttaaataatttttaaataaatgatcatgactttgttggtcctcctttgctgagcactaaaatgatgatgatgatgatgataaaataataatatacattaaacaatccctgcagtactacttaactattttttacctctatttttgaatctataaaatacagataacaattgtatttacctccatagggtatgctgaatgttaaatatgttaataaatctgctgatctcagcacatggtaggttatatgagaatgtctataattactatttatattactatttataattatcccatttgtaaaattgagggcagtgggtatgttgttatcctaattggggagtagaggaagctgaagcttggtaaggtctgtaattctctcaagtccacatgggggacatcagtggaagtcgaatttaaatcccacttctctcattacaaatactctttccctaactcagagccttctcacagaaaactgcagaaagctggtgagctaccccatgtgcagaatgctctatcagtgactttgtcagagtagcagggcctgaacaaaagccaggtctgcccttcttttaagtcactctatataagagagaagtacttttgacatgcctttcagttaagtgtacttaaagcaaagctctcaagctttccaatgactaaatgctagaggaaataatgggaatagtcaatacctgtaactgaaaaattgctgactgtgtgacacagcaaatcattacactgttcaaataccaatttataaagctggagtgatcatagctgtctgggccaattcatcttagtctctcttggtttggaatgaatatttggttggtttagacagcaaaagcctttgacccacaaatgagaggctaggcttgccagatctagtaaacaaaactacaagcttcctagttgaattttaatttcagataaacagccaatacttctttagtatgttacaaatgttgcatgaggcatatttatactaaaatattgcttgctatttatctgatattcaatgaaacggagtgtcctgaattttacttggcaatcctagcaggggcttactttgaaaagttcctacctaagactgagcagttaagggaggaagttgttatagaatgaatgtttgtgttcctcctaaagtcatagtttgaagccctaatcctcaatgtgatggtacgtggagatgaagactttgggaggtaattagggttagatgaggccacgaatggtcaggttctcatgatgggattagtgcccttaaaaaacagataccagagagcttgttttttttgtttttttttcaccccctaagtgtgcacaaagaggtcatgtgagcacacagcaagatggcagccacctagaaggcaagagaagaagcttcagaatgaaacctaccttgctggcacattgatcttggacttcccagactctagaaccaaaaataaatttctgttgtttaagctactcaggccatggtgttttgttatggcagcccaagcagactaagatagtaatactaagcactttggggcagtggcaactaccccatctcactcaaacccttcatcaatggtggtaccaagctgtgtagacaacccttctttgcctaaatttcttgagtccccaagatgtccaatccctaaaggaactagtatgtaaataatgggagtcatatgggttcttttttcccattgaacgacagatcgtttctccacatgattggctgcacctttcctattttgctgtgcatttctaaaactgagttccattttttttttccccaggctacactctttcaggttccagtcactgttgtgcaactgtctggcttacaatctatgtttattttaaaatcccactaagaatggatttagatatataaagtcccggcctagtcacttttagtcctttttcctattgcctcttaaatgttgttttataactgaatgctgaagtcagattttcttttttacttcagaaaacttttgctattgaactgttgaaaatcttagcctaaataacaaattcttttgcaaaatttgtgtgtagattccaaaatctccaccttgttgaataaacttttccaattactttggcacacacatatgaatctagaccttttcagatttctacactgcattctacactaggcagtttagctcttggttataaaccatggtttagtttcattataaactatggtttggttgagctcttggttataaattatgttttaattttccttctattcctactccattttttcccgatctgtctttcccatgcacacacccatgcatgctcacacacccaaaaaactgttaatcctcatttatttttcattcatctttaaacataatcagtgcagtgctaaatacataactgctgcttaacacattagctgttgattattttctgatatttgcctgaattacactcaattatttttaacttttgaaattatttctgtattttaccttattattaacctaagaggaaaagaggaaaagattttatctggaaaaaaataagatgattctcaagaaattttccatgaagaacttgccaaaacataatataaaaagaattgtggtttctgaaatttacttaaggcctcctggatgttgatcttttcacactgaagctgatttaattttgcccctgagcttgtaagcaccagataatttgcttgcttggattgtcactgagtctaataagtgtcggtcattaataaaactttttcagaacatgagaatgatgtaggaatggtgcggttatattatgaaagttgagtgtaaatgattcttgggaggaaaagatttccaaattatgcaacgaatggaatttactcaacttttaaagatccaaagggaggtaatatgtatgcagtaatgcttgtttaacagacctgggctgagcttttctacccaaaatagatatattttacataataatgctatatattggtttattataagttacatgagcctggattcctctgtaagtattgcttactttacctcatttcaaattcattatagaattcatggttcttttgtgcttttttagaaaaagatatttccccaatggatattttacttcctttcaacctgcttctttacctcctccaaaattctaaattctgactattaaacatgatttaatgagctgagagtaggtatgttccttcactgtgattacccaataccccatgcatacctcaatcctgccgagttgcaatcttcattttgcctgactatatctcttgtgctaaactactggctcttcagaagcaaggccggctgttatcctcaaggtgtgtaagtcctagcacatgctggtacttgacatatgcttgatatacaaattaaaaatgagccgtgatgatcccaggcactcaatactagtggcagtacagtaaagtggctgagagcaagacggtctctgcagatccttggcttaaattcccattgaaaacatttcatttcatttagagaaatgtcactttgaaaagttctggcattttatgtcctttttaatgctaaccacagttatatttatcttttttactattattcaatgtgatcctatgttgtctgtacttttaacggcactagaaaaaaaacaagtatctccctaccaataataatgagtcacacaagtgaaacatatttaggtaaatagaaattttgctatatttaaccaatcactattgaacttaataccataataaattatacccatttacatttgattagcacttgcaagtttatacacctttcccataaattatcttatttaaaatggcacattagctttttaattatataagaatttcacaaatatgtggttttgtggaaaatctgaagtacaaaagtatatacatttaaaggtagagttctcattaacctgagataataaaattgcattttctccacacccctccaaggtgttgggtgggtcacaggtcagaaaacttagcaagccacgagaggtaggctgacagatggttgggacttagcaggagggtttgcaaagcagtgcaaagcaatgcaaaagaaaaggtttgcaaagcagtgcaaaagaaaagcttgggcctgaaatagaaaatctattttaaaagaagacatattgtgtcaatagttatcacaatgatacttgagagtttaagcaccccaaaagaataataaatcaatgatcagcttcatcagatgtaactgattgtattgcatcactgaagctaatgtacaagaaaattatctgggggaattagcttgcctagtttcatggctccttaaggaagcaataatactaactactctcaaagcaacaagaaggctgtcagctgtaggcgctttcatgtgaaatgcccctatttgatgccctgttagagtccaattcactgctagtgttcttagactaaataaagaacagtagctgaaggatttgctatcatatcataatgtgtgaaaaatgctacagtgtccctttatgagatattaaaactgtatgtaaatagaaataaaactgcatgatgtcaccatcacgaagctaagttttaaaaaatgttcttcaaattcagaaacaacctgatacctatagggaatttagattctttttgactagaaacatcaagagaacaacatacctgtttagttcggcacagtgtacgctctattcttgggcgatttctacatgaaaattagtaatgtcttgatgtcagaaaaccatatttccttttctttttctttctttttttttttttttttttgagacagggtcttgctctgtcatccaggctggagtgcagtggtgcaatcatggctcactgtaggcttaacctcctggtctcaaatgatcctcccacctaatcctctctactagctgagaccataggcatggaccaccacagctggctaatttttttttttttttttttgactttttgtagagacgaggtctagctatgtttcccaggctgttctcaaactcctgggctcaagtgatccttccaccttggcctcccaaaatactgggattacaggtgtgagccaccatacccggccaacatatttactttaaaaaagccttcagcgcggtggctcatgcctgtaatcccagcactttgggaggccaaggtgggtggatcacgaggtcaagagattgagaccatcctgcccaacatggtaaaaccccatctctactaaaaatacaaaaattagctgggcctggtggcacatgcctgtcatcctagctactgtggaggcagaagaatcgcttggacctggaaggtggaggttgcagtgagctgagatcctgccactgaactccagcctggcaacagagggagattccatcaaaaaaaaaaaaaagaaaaatccttcagaatcccattttcttctctatcatcaccatactcatgttcatattatctaagtcttcataaattatattgattacttactctgcttttttctctttccccggaccctgctggtttagtttccagcatcaagtgttaggcttattgccatcaattccttagtgcttttctcaaacctctcttcgctgcagatacgatgattgaaaacaaacacactaacagatatggccatgaaactttcctgtttaaaatccttcaatgatgccctcttcatccaatgaacagttgtttccttaatagcctctagacgcccgcaagaaagagcccaaactcctttgcatagcatgaaagatgtttctgttttttgcctaatgtattgagtaacatgttttgctactctcctcacacctacttttcagaaataacaaatcccatgttgtgtcttgaacaccatatggtacttcccattcccatttactttcacacgccccttgcaccttccgaaatgtcatcgctctctagttcacctggctactttctacatagtgttattctgtgacgcttcctcactatattcggtaaggaaaatgtactacctctgtatcttattattgcttctcttgttgctcacaagttatatatgaatttgttacatgtttatttctcctatcaacacatgagattcttgaaggcatgaactttgtcatatttatcttcctatctccaaaacctactataaaacatgcttcataataaacactcaatgagtatatgtggtttgaatgaatgtacttaagagaaaaaaagatagtaatataagccatgcttttattttaattaatgacattttctagttttccatttattcaaatagtaaaattttactaaaaatggtagttatgtaaacattagctaaagatgacctattggacaggcaatttgcaaataaattattttcttcttagatatgaggtaaatcaatagtaacttagcaatgaagatataaacttagacattatacctatattccagttggaaaggtggatggagttaatgctataaacacttcaaaaaatgtatttctatcctcctaatatggacatctctaatagtttctgcaactccacggtataaaaaccctctgctatgtcctctcaaaacacctcctcaatctgggtcaggcctgcctttcctcaattcaattctatctttatgtgcccatattctggaccaattgtgctcaatggcatctatgctttatttagaataagaccctccaaagtttctaactcttgagtctttagtctaccaatctgttcatcttaagtgaaaattgattttcctctgactccattttccttgagggttatgaaataaaatgagatttggtgttccatcatttatacattacccaccatctattcattcaacaaatatttgggtgccacattcaagccactattccatcacccttgctctaacttcccatccattaagaattatgccatcttttatcaggctttctacatctttgtgctatcacaaggaaactccctcagcttttaattatttgaggacatgtacaattttacctttttttccttttttatatccctggttgcttatgtcaactttcacagtgatgatcttctaacataatagattccatgctttttgatgttcagcattattgttacactttagttttctaccaccctacactttcgacttcaaaaatagtcttttgtcagagacagagtttcgctcttgttgcccaggctggagtgcaatggtgtgatctcagctcactgcaacctctgcctcccgggttcaagggatcctccttcctcagcctcctgagtacctgagattacaggtgcgagccaccatgcctggctaatttttgtatttttcacttgttttttttgttttgggggtttcaccatgttgcccaggctgttctcgaactcctgaccccaagtgatccacccggcttggcctcacaaattgctgggattacaggcatgggccattgtggctggccaacttccatctttataataacctcctctttgcctttcatgcaattgctcttattgaaagtaaatagaatcctttcaataaatatctgtcccagggtttataatgagtcacacttcagtgcaagacatacaaagtagaaccatgtaggaactctattccaatggaagtaataggagctacaaacttatgagggaagcagataagaaaattcaccattacattagactcatataggtgccacaagaagggtatctggagcaggagatggaggtccagcgtaaagtaatgtcagctaaatattttgggaacactcttcaagaatttccaactcaaatgcttccatgaaagcattaaaaactattccatccctctggatgccccaaaagagtttgcataattgtacataacacaaaaataatcttatactgaggttatatttatgacaagttttgtatctatttctaaacggtacgttcttccagcagactgatttaacactcttcgggtcacagacgttttaaaaaatctttttcataattatttggcaaatttatacctatctactctttagggacttttgtacaagctccctcacaaaaatcttctaaagttataagtttattgcacccatttacatagaaggaaactaaaaattaacagctatgtaaggcatctatgtttacctagctagtagacagcaaacctacattaaaagtgaggtatagtggagactgctaggtaatccccccaatttttttttgtttctttttggacatatagttgagctgtatttcccagtcttcaattccattggatttggccataaaacccagttctagttgatgggatgttagtgaatataatgaaagagatttctgggccaagctaataaaaatgccacacttttgctccttggtactcctttcctttttctagagtactgggaggttagtatcttctaaggcaaatgtgaaagtcatgcattgaagatagccaacctgaacatccacttagacaattaaatgagagagaaataaatctttgtgtggaaagttaacaacaaggcaggctctatttaatactacaggttatcctaccttattgaatgcagtagaccagcatttatcaaacattttagtcttaggacctattgacactttcaaaaattatcaaagatttctaagaacttttgttaatatgggttttatcttgatatttaccttattagaatttaaactgagaaattattaacatatttattcattttaagatataaagttagtacatgttaacataaatattgtttttgaaaaaaatgtaaattttccaaaataaaaaaaattgtgaagattggcattgctttacatttttgcaaatacctttaatatttcggttattagaaaatacttacattctcatatctgcttctggatttagtctgctatgatagtcatcgtagagcttctagaaaagtttactgtacatttattagcaaaagaagatgaaaagagaaatatcatctcagtgttactacaaaaatagattcatttcttgaaccagctaaaagaatctcagaggtccacacctcattaatgatcacattttaagaattactgcactagacctttgacaacagaagttactatgttatccactatgtagtatttaaaattcttaggaaagctacgggttctttcctcaaaaaaaaaaaaaaaaaaaaaaaacacatacatacatacttttatgcctaatttaagtggtttcctaaaacccctgaatctcattcaatggaagtcaaaaactttctctagagtagatggcatggctttttttaactttcatgtatcttctactatactgagaaatgtacactttatactttatataatgtcaataaacatacgctagaaacagaaaacattagaactgggaggatcttcagagatcatactgtgaaattttctccttttcacatttagactgtgcaaacctagggaaggaaagtgactacctcaaggccacagtgaacatgataaagaaaggatgcagaaataaaaacacaatttgcaaagttatgacacatcactcattcatatttaaaatctttaagtgatataaagttatacattcaaagagacaaaaatatttttaggattttggaatttaaggagacatataagccatctatttaaatcatctcatttgtaagaaaaacctacaggatctcagaaggattaaactgctttgctaaatttacaaaatggtaaagacctggtttgccaactctgaacagaatattataaccaatatatcacatttccctttaaagaactcacattttatagtcaattaataatctccattttgaagcaaatttataagaatagcaactgatgcactgtatttaaaaatataaacaaaatcttcagaatacaccttaataatccagattacaaaattgtattcactttattttgcttctccagatttaaaaatgaagagagcaaaggctgggaaagttagtcatctaaaattctatcttcttttgtcaaaacaatataacacaaatataaagttattttaaaataaattgttctggcaaattggtaccctgacccaacgaggaggttatgaaatccagtacccctccatacttcattgaaacttactcaaattactgcagtagattttccactcttggaaaatgagcaaataaatggcagcatcctttctaatgtcaattctcgacattctgattaaagttctgttttaagtgcccagatacattaaatcaacccattgttttccatccttacagatagcccagagttctagagaaggatggcgactacaaagaaatcaatcatcaggatgtgcttcttttaacacataatgctgttggttaattgggttttttgaaagaatctggaaagatccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccacctcacaccagttagaatggcaatcattaaaaagtcaggaaacaacaggtgctggagaggatgtggagaaataggaacacttttacactgttcgtgggactgtaaactagttcaaccattgtggaagtcagtgtggcgattcctcagggatctagaactggaaataccatttgatgcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacacatacaccatggaatactatgcagccataaaaaatgatgagttcatgtcctttgtagggacatggatgaaattggaaatcatcattgtcagtaaactatcacaagaacaaaaaaccaaacaccacatattctcactcataggtgggaattgaacaatgagatcacatggacacaggaaggggaatatcacactctggggactgttgtggggtggggggaggggggagggatagcattaggtgatatacctaacgctagatgacgagttagtgggtgcagcgcaccagcatgggcacatgtatacatatgtaactaacctgcacaatgtgcacatgtaccctagaacttaaagtataataaaaaaaaaggaaaaaaaaaaaagaaagaatctgatataaatttggacttgcattcaaagtccctgacagaactactgccaagaaacggaaaagtaatgttttcctaaaactattacttgaaaatcttgaaagaaatgacttatgcataagtatttaatagttttcctatgtgaagagctgccaagacccaggcagcactaaaaaatggaacctttctattgtacattgtacttaaacacctggtgtggaggccacattttttcctgctgtgtggcagacaatgaagtgtaatactgacattctctctgaaactctccaagatctactaaataattccctgtgtagaggtagaaagttcacctaagaaactcccaaaaggcacataacctcagtcaagtattagatcttactttttctaacagaagctagagagcaaagagaaaacaactgatttcttcacaatggcaaataagaaataatataacagaaaccattctacatgagtccaaagcagaagctacaacaaattacttaacacaaagcaatagcaactgggcaattcgacagaattgtgaatccacgccatgaattcatggcatcattttactaaaaaacacaacagtggatggcagtctttaggatatatcttgatggacactaggaaacatttaataatagttgttgcctgttgttttgctattttttgttactcaagcagcagcgaagaggggagtaaacttgtgtttacagctggctctctgtattcacaggaaattggttccgggacctccttgggataccaaaatcctgggatgcttgagacctgtaggcgctgtggaacccttgaatatggagggtggactgtactgatcagctcctaaatgtcaaacacttggcactttatatccgttttaattctcaaaatagttctccaggtcgggtatcattattttaattttaaagacgaggaaccaagtttaagagagtaaatactttaggtaaatactttagtaaatacttcaggtaatgccaccagctagtaattgctagaactaggattcaagcagcataaatagctactcacatgggtttatgacatgacgagcactgtgctaagcaacttacctggattggctcattaaatcttcctcataactcttcaaaagaggtcctaatattttactcacttaaaagatgagaaaacaggccaggcgcggtggcttatgtaagcatgtaatcccagcactttgggagactgaggcgggtggatggcttgcggataggcattcaagaccagactggtgaacatggtaaaaccctgtctctactaataatacaaaaattagctgggcatggtggcgcacacctgtaatcccagctactctggaggctgaagcaggagaatcgcttgaaccccagagatggaggttgcagtgagccaagatcctgccattgcactccagcctgggtgacaagaacaaaagtccgtctcaaaaaaaaaaaaaaaaaaaaagatgagaaaacaaaattttggagttgttaaggagcttgcctaatcacacaaatcataagtggctgaacggcagttcaaactgagagtgtttgacaccagaactccaagctttttacttatcattccataatgtctcccaattttaatgtccatgctctttcctctacaggaatggggcaggggggagaaaaacagtaaaattcacacttttcattttcttccttcctctcatccaattcctaaaagagtaagacaatataacacatcagtacttttggaggttcaaaagatgctaatgataatttatctgaaggtttacttcaattgctgaaggaaatgttttctagaagaaaaagagagctcagcagagtacacaactatatccatattgatggatacctgtgcaataaattttccaatcaggggcaaatcaaggccaatcatgattcatcagcagcctaagagacagcatggagtcagacaatttaaaggtactccacatgtcttctgaattctggtctgtttcagatggcactcaatgcacagtctaggttcaaagattttttttctctggctgcacttggtgcaagctgtcaggtctatttttgggggtatcctttagaaacacaacataaaactgtataaccatgaaaaagaaaattcaggaaaaagctgccatttcaaatatttttatgttttttatcatagtggtgggagctctacctttacaaggcaaactgcagcatgatcctggcaacctcccgtgtaaatgcaagcaaattactagacaactgacatttcttgggcagcaaagatttcaatttctacaccctggtttttggaaattctgttctggctagttgtatttgaggttttgacagccaaataaatctgctgcaaagaatgttgcacatttcattaaaaatgctccatctagacacacatattctgtctgctatagacctgaatgcatgattgtgtgaacatgtgagacacagaatttcagtcttgaaagatggctcctcagtgaaactccttttttgtacaaagaaaattagttacttgtgataatgttgcaaaactagagctaataaggtatccaggtgtgttctgatagcaacaacaacaaaaccctacattcattatatgtactggttaactgtgagtaaagagttatctttaaaggaataattatatgagactttgtcaaggcataagtataaattatgctgctgattaattgggttttaaaagaatgtgaataaatttagatgtgaattttaagttcttgacagaactattgcccagaaatgagaatgtaagaagattttggatatttttttcaggacatgaaatgattgtttgaattctttcatcaactgtatttgcttctattttcttatgctgccaatcaaatgaaggcagcaggaaatgcaatctattagacttaatcacataaagtttaaatcatatttaactattcagttgaagaaaaataccagctaaactaattacagaactgaaaaatggcaatgataaaattaagacccaacaaaaagacacgaaatacctaagaaattgagaatcaacaaatctatacaattgtcagtgaagacagtcaatctttgtcattaaataattttaaagagaattatttaattatttctccatcaaatgtcttttatattgtatcacaattaaaattctggaggtctccttcattaactagacgaaattaaaatgatgaaaggtcaatctgacaagaatattgataaattgcacataatgtttcttcttgtttcaaaaagcaatataaacaacttctaggacatttaatttaaaaactgagaattgaaaacttttaaaaatattgtatattccattatagatagatagaaaaataactgtctcattcttttagcttatgggttctttgaggattaaaaagagtatcttattctaatttaggaattttgctagttgctgagtatgtctattctaattatatattctggaactgggtaaaaaactacaggatagatttggggacccactggacccattaatcatatgacttccatcagccctactctgactagtcaaccacagtgacatgcttgtatcttctggaattaatagcagtttagagtcaatgtctaatagtccccaaaggttctgattatttccttttccctaaaacacagtcacccagtaaaaggccatgatttggggttagaattttgttcacttgatctagaactctttgacttacacagatcaagtaagaattagtagcattcccatccatttaacttctaggaactctatcatcaactagccaatgccataggactgcccatattcaactattctgattgccgctttgactctgctttccatcatggtaacaacacccatcttatcttgggcgactgagggctgccacttggccagcccctgccaccccaggattcaattactcccattacatttaagtttccttattcagtggtagcagttcccactgtattttccggcagacaaaagcaatcacaaagctcttcaaggatgcaggggtgcccctcataaacttgttttttacacttaggatgaaaagtgtgccctctgggtcatcccagtgtaagtgagcagatcttaaatgacacattcaatctaacattccagtctccctaaaccttggaatctcttattctgcagtacaggaaagcagttctagcatttcaagttaaattactgtgggccagcttctgatccatgttccagccaaccaaccaaccaaccaaccaaccaaactgatacagccctttctcaatccctgagctacagcattaaattcagaatctctgcttaatgagtttctttggatttgggaggcaatacatttcttattctggtttgctaccccagcctagtaacagaatgacccaaaaagctgctaacaagagaaggctctgcaacaggtctaggctgccatataggtgccctgccactggggtcatatgatccagcagattcaatggtgtttaaattgttggtgacagatagggattctacttaaaatctttgacaggaccatacaggacaaccatagtgcatactcagaatttcagaccaaagccctgccactctctgcagataactactttccttttgagaaactgcttttggtctactactgagctaaaagcctaaccatggcacaccaagttcttctgcaaactgagctgctcctcatgaactggccgttacctgtcctaccaccaaggcataaagttggctgtacacaacagcattccttcatcaaaccaagaagtggtatatatgtgatcaggcccaagagggccctaaatgcacaagttacatgaagatgtgtcccaaatgcccatggtccccactatgctatattactacatctcttacaacctgcacctatggcctcatgtggagtactccactgtcagttgacaaacttgggtctggtttacagatggttgtgcataatatacaggcacatacaatagacagccacagcactacagtccttttctagcacatacctgaaggataatggtgaaggaaaatcctctcaggcagcagaaccccgagtagtgcatctagttgttcactttgtttggaaggagaaatgcaaatatataccaatttatgggctgtggccaatgatggtttctctggatggtcaaggacttggaagaaatctgattggaaaattggttcaaggaagtttggggatgaggtatgtggatagacatctctgaatgggtgaaaatcatgaagatatttgtgtgccatgtgaatgctaaccaaagagagatgtcaggagaggagggactttaataatcacatagataggatggcatgttctgtggataccagtcagcctcatttttgcagccactcttattgcccaatgtattcataagcaaagtggacattgtagcagggacgtaggttatgcattggctcagaaacacgaacttccctctccaaggctgacctacttatagccactgctgagtgcccaatgtgccagcagcaaagaccaacactgagttctcaatatggcaccattcctcagggtgatcagccagctacctggtggcaggttgattacattggactgcttccatcatggaaggggggtagtgctatgttcttactagaatagttacttactctggatattgatttgccttttctgcacacgatgtttctgccaacactacctactatctataaacttacagaatgccttatgccctgccatagcattccacacagcactccttctcatcaagaaaattacttcatagtaaacaaagtgtggcaatgagaccacaatcatggaattcataggccttatcatatccccaaccatcctgatgctgctggtttgacagaagagtggaatgaccttttgaagactcggttacagtgtcagctatgagacagtaccttgcagagctatagcatgatcatggaattcatgggccttatcatatccccaaccatcctgttgctgctggtttgacagaacagtggaatgaccttttgaagactcggttacagtgtcagctatgagacagtaccttgcagagctgtagcaaagttctccaggagtctacatatactttgaatcgatatccaaaatatggtactatttcttccatagctagaattcatgggtccacaattcaagtggtgaaaatggaaatggctctatttactattacaactgatgacccattagcacaattttgcttcctgctcccatgaccttacgctctgcttgttcagaagtcttagttccaaagagaggaatgcttctagcagaagacacaacacaaattccactgatgtggaagttaaaattcacctgatgactttgggctcttcatgcctctgaatcaacaagcagggaaggaagttacagtgctggctgggataattgatactgactaccaaagagaaattgacctggtactctacaatggaaataaggaagaatatgtctgaaatatagaagatccttaaggcatcccttattattgccatgtcctgtgattaaattcaatataaaactataacaactcaatttgggcaggactactaaaggcctagatccctcaaaaataaaggtaaggtgacccttaccagataaataactgtaacctattgaggtacttgctgatggcaaagagaatatgtaaatggtaatgaaataagagttacagcgatgtaaccagtacagaaatgggaactgtgtcatgtgtatttttctttgttattttgttatgaatatgttcaagtgtgtgcatgtgggtatctcaaatatctgttttcttccctctcttttccccttaccatataacatgagatgtattgactttatattatagtacttaagtaatgttaactttacatcatagtagttaagttagaggacattgagaagaataatcatcaaaaagactttcaaggattttgcatcctcttttaggggaagggttagtgcatttttagttgtacacaggatagtagtattaatcatgttaagcaaaagtattgccttgttattgtctttaattggagattaattttggtttaagatgtatatgagtgccaggtttacaaaaatggactcatgatggttaattttatatgttaacacggttaaatgatggtatccaaatatttggccaaatattattctagatatttccatgaagctattttttagatgagattaacatttaaatcaatggattttgaggaaagcatattaacctcaattgtgtggatgggcctgattcaacagttgaagaccttagtagaagaaaactgaccacccttcagcaagaagaaactctgcaaggagactgccttcaaacttgaactcttccctgggtctccaagctgccagactatcctgcagatttttgacttgttggcctccataattatgtgagccaattgtttgaaataaatctctagactgatagatgatagataggtgatgatgatgatgatagatagatagatagatagatagatagatagatagatagatagactggcagaaagatagatagatagatatcctactggttgtggccctaattaatgtatccccaatgctttactcattaaattttaaataaactttttctttttcattttacatatcagaaaagaaaagccttctaagttgtgtaaggaacggtgtcctggttttaaaaaaaaaatcaaacaaaaccttggaagagtaatttgacattgtaatcctttcatttcacagcaactccatgaactcaagattgcaatgtagttaccatctacagagatccagagtcagtttggattctacaattgtaaatacacaagcagaatgaacttccacctgagaaatcacaaatcaaatctaatattacttttggaggaaaagggttggagaaattccaataaggtaagcttacagaactcatgtccaacccaagctatagaagagccttatggaataaaccgaaagaactagattgatgggaggcacagccttgttctgtgggaagtgatgcatatcttgaggggcatagatccaaattgtagacaaattatataatcttggcaataagacttccatttccaatccttgattttcacatctgaaacctaatgaaagtgcagcaggtaaaagcagcagatgaggaaggggtaagtccatattcgaagctaccctgatccccttactgtttctgtggtattattattttagtcaacgcctgggtttactctgggcatctcagagtccgctggaattctgggtggatcccataaattctccaatagttgtctcagtacatttagtaatttatttataccttaggttttgttttggttttgtttcatttcattttggcccttaaaatgggatactgcttgtagtttgtagaaggctttgttaatttattttgatttttgatctctctatgatttatcatatgtcttcaaggcatattaagattctaggaaagaaaactggtgtagtgaattcatttttctaagaatcataatttgttattgtttgcaaataaatatctgagactgtggaatccaagagtatctgagcttaaaggtaccctagggtaccagagataactcttattgaacattactatttgccagatgttgtattaatattaccttctttattcacagaaataatcattagaatagcaataattaccaattattaagtacttgagtgtgtgcataagcactcatgatttttacttaaaataaaattcattccagtatagctggaatgtgttgcaaacatattaattcattcaatcctgaagacaaccatatgagttgtaccattatttctcctatgttatagatgcgtaaaatgatacagacaggttaaataaattgcccatatcatacatttagtaagcaatagaaccgaaattcaaagcagagactagctcccaggtctgtgtttttaactactgtattaagcggttaatggagtttccttaataaatatacattgttattattctcatttaagagataaacatctgaaagtcaaattagctaaataccttgcaaaagtcactgtccctaagcaatgagtatctgaaatactagtgcactttattctcgttacaaaaccttgaaatacttatatgcccatagaaaatctagtgaaaatccagacagatcccaattgtcacagattgggatcaataccactattctgtctaggctcttgtgtgggacagttcccagtctaagacctcatatctgcctatctctgtgctgtccttgatcgctgaaccaagccccaaacctatactccacaatttcacgtctgtctgggatgcgctgctcagatgggctgtatgagtggcaacacaaccacttcaaaaacagagactgtctcctcctgccatgggtagcaatgaccacaactctcaaatcattttgccactggatactaacataagagcaaaagactctataattaggtgatgaattcagatcattggagcacacattttacattaaaacacttctgtggcttcactctcaatgggcacactatttcaaatgcactttgttatctgttgcaatatcaccagacctgcagtaatatgctcaaatctcatttcctccatgaatccttttctgattcctacagtcctaccaagttgtctctcatctgaatcataaagagcgtatcactcactttatttctaccaccctaatccttcattgtcttgatttctccaacaagatattaatcttgtcccaagtaaagcctacattattatcctccacttggccttatgctgtcagactctgtatagtagattctataatattgctcccagtgaactgatcaaattggttgagttgccaatgtagttcccactgcccggaataacatcatatccaatcaaatgtctttcttgctatcctattaaatgtgcttacctacagaagttaagtctacctcctcagtggcttcatccacctcttcattaatgagtcaatattgttgtctttgttggtataaagagtaagaagaagcacatagtgtatttctgtccatactaatataaagataccgaattgctatattgaatcgctatagaatagcgctaaaccaaaaatttagatctccaatcagatgttctttttttttcctacaagattttaatgaaataaatactttaaaaatgtcctggtatttacattttcaatttaacagccatgccccatggttggcaaatgcaagcgcatgggacatggcaatactataggtgatttgctctccattgcccaagtgtggcaacccccactctcttggtttgttactctccctggcactatccatgaagttattaacacatgccactgattatatctatggcaaatcaatcacattctactacccattgcattaaacatgaacaactttaccctcttattttaatagcaaatcagggagtcattatttagaaggcacaatctcaaatgagaaggtaaaatttagatttacaattttattttcccccaatttcttctaatcattcttattttcctagaataaaaaaaatctagaaagttttgaggggaaaaaaaaccacaacagtttttcagtcttttgtaattgaaagtgaatagaatggtgatttgagggtgctccagaatcctaaagtattctaaaacaaagactacattttccttctaaaaatatatgtttaatattaaatatatcttttaatctaattatctttgagttgcagtttatcttatatcttaattatattttagttagccaccatactatatttattaaccttaccagaaaatatagtacatgcacatatacacattttttggaagaagaataatataaataaatgttgccagaattctacagggaaactgattactacaatttatcttcctaatagcgaacttgtcataacaattttaaacattctttttcattctatctctcttatcctgatctcatattaatatgagatcaataaaaaagactgattggaaggcaggggtgggcactggccatggacccttactccgtgcttatcatacacaataatcctcattttattccattttctgaaaaagacctactcctacagattattattaagaagttgacagataactgagaaactcatgaatagagaaaaaataaattcacatcacacatcacaaaaaagaacaattagccaattagtcaaattcctttttgagatctgggttcttgtctgttcattgtccctcatcttcctgctaactagtattctctctgtgtccatacacaagacatgaacttgaaaaatcattctattgttctcaacatttcagctctggccctcaacttacgtaccccactcaaccatatcacaactcacagaaaaatcaccacaggctcctcaggcctgccccttggaagacattctgctacaatgatgctttttttttttttttttttttttttttttagacagtgtctcactctggtgcccaggctggagtgcagtggcgtgatctcggctcattgcaagctccatctcccgggttcacgccattctcctgcctcagcctccctagtagctgggactacagacgctcgccaccacgcccagctaattttttgtatttttagtggagatggggtttcaccgtgttagtgaggatggtctcgatctcctgacctcgtgatccgcctgcctcggcctcccaaagtgctgggattacaggtgtgagccaccgcgcctggcctacaatgatacttttaaaaaacagatgaatacactgatgtccttcatccctgcaaaacgaggtaaaccatataaaaatatactccaaaaattcattttaaagcaatttctactttaagtccagtaagctgtaatgtcacatgttttgtatgtggcaagtgttttaatttattatttaaaatgagaataaatgtgcaaataagcagtaagagctcattgtatgaatatgttatagttcagggaagaagacactgagactgtgtgaggctctttataaactgtttagtaattcctggactctggtaaattatggggagatgcagtttacagacatggtaatatcttgcctgaaatggaaagaactaccagacacaccttccacagtctcaagctctaaatcataaatatgttgagccagtcgtttacatcaatttcaaacacgaagggcagagattagagacacattcaatagaaagtataaattggctgaataattatttgccaaaattttcattcacatatagatcatttcaagaggaaatcagggtaatcaagcattggcctaactctgaagtggcaaagtagggttgtttagaaaggaaaaattctgtcaaatttagcatatttattttctgtttacataatctagtagaggccccgcacatcatagaaagtcaaatatttgttcatctgattatgacatgattttaaattcccttgtgtttgctttatgatatatactcctgtccctcctgtttgaacattttatggaatgtcagtttggttataattaatatactctagctcgtgttcagtatcgagtctataatgacttaacattctcaatcaatttagtggaagataaagacaggatgttgaagttcccctcattccctgacattatagcttacattgaatgctgaagtacttttgtttctagatgaccagttacttatagttattttggattggtcattaggtatattggagaaatcactgttaaaactgtactggaatggcctagaggaaaagcatcagaagagaaagataattaaaaggtattattaccatcatctttatacagtgctaatttttaacaatcatttttacagtcatgtgaatgacaagtagatgctatccagaattcccatcattggagcctgtatttcattgaattaacactcaacaaaaacatgctaagtgtctcttaacattatactacatactgatgctataagaaagagataaaaatgagaaggatatgtaagacagtatggcaattgaaaataaatatgttcaaaataagtacctctcttgggtggtaaagggataataggaagaatgggatgtcttatggagtagttagttccctacatctagggtgttttcaagcatgtgatccatagtgaaacaggccttaaaaagtcccctgtagggtaataatttgtaattatttattggctatttatgtcttgttccttttatcctcttcacggctccttttgcaaatgcctgtatttctgtgtagttaagataaagatagcactttttaacttgaagccttgcaaagtgacattttctccaaatgcacttggtgaatttttttatacaactctaaactagagctgaatcaactgtagggaatgtgctgaatgtccatccataaagggaaacaagattaatgacctctaagtgtgaatgggcaaaagcaatttacaagagtgagtgagggtcatattttatcacaggcaggtggcttattccaactttgcaaacagttaccaaaaatgcacacaaccacaaatctttggcctttccatcctcacgtgaaaccattgtgtgtgccagacaaatgatcctactatgttttaaccccaaactcaatctgcatatgttaatgaagactaaaatagattgctagaaaactccttgaagcagaaactaacagaaaaagcattttccttcccaacccactccacaggatctgtacttcacccagcaagaaaaggagcatgaaattttgcttctcactatgtggaaaacccttaatgcatgttctgctaattttggaatttaaaaattttctttcaccttggactttgtccttgttccagtgaactgtgacttcaaatcagtatatcatatggtgtttgtttttatgtttttggtagtcatagtagggggtgttagaaggtatgtaatatgggaggacactggtaaaatctttctagtacaaatcataaaataacaaaaataaaaacacttgttccaatgatattggatctctattcttctccttgaggtttatgcctctagcataatttgggcacagcccactctagtactctctaaataacctgtgcaagttattatacttctgcatatctgaggtcaggaaagaggggtcagacatttggaacaaccaaaggatattagacctagtaataaaatagagagccaaaggatattagctgtctactgctgcataaaattttacctaaaacttagtatcttaaaacaacatgaatttattatcactcagtttctgcgcatcacaactccagacatgaaataactaggctctcttgattacgatttcacaaggtcaaagttatgatgtcagccaggcttcatttccatctggagtttgggggtcctctgaaaagctctcgtggttgtagcagaatttagttctttgcaattgtaagacaagatgcctattctttgctggttgtcagcatggggccactcagctccttgaggccacccacagttctttgccatatggtcttctccatctttaaaagtgagcaatagtgactctcctgctgaatccctttcagatttcaaatctctgttaccataaagagccttgcccttttaagggctagcttgtgtagatcaggcccactgaacatgatctcctttctttaagtaaactgtgccaaataacacaatctaattatgagagtggtattatggcattgcatcacaagcacaggtctttctcacagtcaaagggaggatattctacaagagcatggttcattggggcttattttataattctgtctaccacataattcttgaagggagtatcataaagccaaggcctgaggcaaggcaagtaagctgctatcttcaggagggctggacagagaaggcaaggagagggcataacaggaaatatggatgttcacatgagtgatgactgccatctaatgaagattagggataaagaggatattttgtccaagaaatggcattgttaatactccatctcacaactgtttagagaaatgggaataattttgttaactgcaatttaccacttcctaatggaaaatattctagcacagtgaccttgtgtgcaattgggtgaccaagctgatgtctaccaaccctgggtaaagccaattatgaaatatgatgaatgctgaatgactcaaaagggctttacataattagcaagagccaaagaaactaatgaattcttttacaagaacaaaacataacagcaacaaaacaaataaatgaaaacaggatgtccttagaatcctcaatataggttgcaagttgaagactttgatggcagactttcaggattcaaatcctaactttctaacttactaagtatttgaactcaggtaagttattgaacttcattttatgtatatagagctacagatatatacatctatgtatatatatagctatgtaatacagatatacatataaaatgtatatataatttggacaaataccagaaaagtagtttgtatataatacaaagtcattattactagttgtttatagtcctcttaatattactggaactaaagtttgtgtgtctcagccctaacaccgacattgcgaagttccaacaggtctacacctctaacacttctatatttatttatttgctcatccatctaatcttctggatggtaaatttcttaaggtaaaaaagttgtgcttctcattgatctaccttttagtggacaatttatgctggcttgactatcacaccagccttaacagtaaatcatccttgtagtataagttttcagttgtggcaggctttgtcagcaacttattcattttacatttatacttctagcagaacctggattctgttaggggcaacagagtgtcaggctctttggcccaccacctcttttggtaccattttgatgaaaaagtatagggagaaatacctcaggccttcctgtctaaaatggggatgtcaggtgggaggtggaacacccacttagtgacccaaaggaatattctagaagacagacacaagctaaagacattaggctgaaagatgtaaggagcctgagacattggggcctgaaaacctgctgaagccatgctggaaaggctactcctgtgcttgctgatatataaggaaaataaattttccttgagccacatgctacaagtgccaaattttccattgagccatatgctacaagtgccagatttctgttaaatgtagcctggtacatgttttaactgctgcaacagtgtattcagcatcggaggccaaaagatcaccaaagagatcaccaaagaatacagttaatccatattaatgtcatcttctgccacttgatgatatataattggatgtagagccaccgttcaagtaatgtgagtgggagcaagaggaagcaaacaaggagaataatgcagtaggatgtgcttaagcataacttcaagcaatgtggagcaatcatccattgctgggcaacagagaaaggtttccatttagtgtttcattttgcatgtgatatgtcatataattcaatccgcctgctggggaaagggaaccacaaacagaaaaatgtaaatgtggctacagacttcaagagcaccagacctctctggtgatattccacaaattcattatgcacctttaggcaaatactcacatacccagaaaagtgtgtgtgtgtgcatgcatatttgtgcattgcaatgtatctgtttgtacataatgattagcctgttcattgttgaaattcagactaccactgttgttagaaacacagacctggggcacactgcctgggttaaaattccatttctacagcttacttctacagcttagcagcataaactcatcttcaggcatcagctttcttatctgcaaaattggtgcaacagatcctgtttcacaggattattatcaggatgaaataattaatatgaggtacccaggacaggagttggaacagtcttgtacatgttagctaatatcagttttacaatgccgtagaagtaaatatgctctcaattgtgcatgtacataatcgtgggtatacaaacacatacatacatattcatatatccatccatctatttctatatagataaatgaaaaatccattgttgtgatatgtgtaatgctagtttacatgttgtagagccttatgaattttagagtccagcagcattaacaacagctactacttattaaatatttactaggtgtcaggggctgtgcatagcactttacttgcattgtcctgtttaatcctcacaacattcaaagatcgtaggaagtattattataagcacagtaaaggattagttacttgcctgtggtaacaaaacaagcaggcagaggaactggacttagaatccaaatccaaatctctcagtctccagagactgaatttttgtgcttgatgctgttatttttattttttgctccacttattaacttagatgacatgtcacacctgaataggttgaagaagtcctcatttaggaaactcaaataagtttctattaatactagaaagtactcgagttaatttcaacaaacaaatctcttatttgccattaacctatttatatcctaggatagtagtgcttggaaaaatgttacaacaaagaatagatagctttataatgaaaatcagaagtatttgctcaatcaaatgtggataaactaatactttctgctcattcacacaagaagcagtcaatttacagttaagtatacagaatgaaatgtaataaatttctctagcatacacacttccccaaaccacacagccctcagagtatcatataattagttccttgccacttgctgaccatttacttttgcaattgttacttaactgccttaatcgtgtacctggtgcaagggcatttagtcaagaggatgcaatctaaagtgtattccacacttccactcgcaatggcaggtgcctaggacatagatgcattcacctaggaaaaggagtgtcttttttctaatcagcactaaaggctgatctttgctaacaaataccttgattaaaatgttttttttttttatctaaagatacctaaagttgtttgatacctctagataaaagggctgtgccatcttgttcatcatcacccaagtacctggggaaacactgggctcatagcaagtgttaagtaaatgtttcattagaaaactgggccgggtatggtggctcatgcctgtaatcccagcactttgggacgccgaggcaggcagatcacgaggtcaggagatcgagaccatcctggctaacatggtgaaaccccgtctctactaaaaaatacaaaaaattagtcgggtgtggtggctgacgcctgtagtcccagctacttgggaggctgaggcaggagaatggcgtgaacctgggaggcggagcttgcagtgagcagagatcgcgccactgcactccagcctgggtgacagagcgagactctgtctcaaaaaaaaaaggaaagaaaaagaaaactgtatgactagtctgcaaagggtggaaagaaaaattgctcctcattctttttttctttcctatactctgcatacttaagggttgatgctacttcctaaatgtcctcacccagaatatctgtgcaatgccaataaaacgaaagacccaggggcctaatgtactattccatccagaaggcagcaagtatatgtgtacagcataacaaataacaagattagatcccatatgagctctcttttgcataatgaaattccacatgttaaaatgcagatttattttaagccctagaagtgctgaccatatgcctcggtggctgaggagatggctacttaatagataatctgcaatgcaagccaaagaactaatcatggccatctgatcatcatgccccatcaaaagccgaaatgaggagacagggaacagagccagaaactgccaacacattttacaagcagggagagaccacgagtctaaagggagggcaggagggataaaatgaacatcttcctaccctaagcaacataacaaaataataacaataagaacatggctgttttagagtatatttgtgataaaacacatgctccactaaatgtattataactatactcttatttaatctcctttcattggggaagttgatgagaatattgacatcacataaaggtagaatattttccaaaacatatatcctaaaaggtggggtccctgatcttaattctgttcacagaacccaagcttctgatcactatcctacagaagatggcacatcatgcatgctaaataaatgcttgttaattgaatgagcatataacacagagaaatcaagtgtttgtcattaagtgcatttaacagatcaccatgcataaatttttgccccaaatgtgttctgcaaaatattgattattatgaatgggatggctctaaaatatcttgggcatctctctgccaccttactagtgggtagaggacagtttatccttaactgatgactgagaatcaggagctaagctgcatgtctttgaactacttaatctctgtattagtttgctagtgctgctataacaaagtaaaacaaactgagaagcataaacaacagaaatatattgtctcacagttctagatgcaggaagtccaagatcaaagcatcagcagggttaatttcttctgagagtagtaaggaagaatctactccatgtccctcctccctagcttctggtggtttgctggcaatcttggttttctttagcttgccaaagcaacaccccatatctctaccttcaggtccacatggcatccctcctgtgtgagcctgtgttcaaaactctcctttttatcaggacaacagtcacattggattaagggcccatatttctgcagtatgacctcatcttaactaattatatcttcaatgatcctatattcaaataaagttgcattctgaaatattgggggttagaacttcaacatgtgaatttaggagtgcataattcaactgctaacagtctcttttatttatttatttatttgcagtttaataactttatttgacaccgagcagttagttctcattgaaatgaactgtagatttttgaaagtggtgacaggcaaaataggtatacagcctgtttggtgaatcttcatctcattgcttttcaggacagccacccaagagtacaagatagaacatttcttattcctttatgccacatagctttgttgagcctggtatcaatgcacacatctggagctctcatctctttcatggaaaatttccagatctctttcagtgcccataagacctactacttgaatcccactccatggatgcacctctaaatattgatggtgtatcctctggccaccttcttgtcgatggcaaaatggcccttcttcttgactttctttatgtgagctattctgccaggctcaggttggaaaggaaccataacagtctcttacatctgagcctttgcacacgatgttccccacacttaggatactccatccaccactgtccccatcctgacctccacattcctttcaactgactaattaactgctcacatcactgctaccatttcccttcattcaggaagccttccctgacccaggtcaataaatgtcagctagtgtgatgaataataataacagtaataatagctgagaaatattaaccaccctgagtagtcatgtggcaataagagaaagcactattgagacttttcaacgctgctctgtgatcacttgctttttaattcttttatcagtctttttttacttgctttttcgttattttatttattaaagaaattaagactgtcagtgagcattagtgtgttgcgtctgttggcttattattttccggtccatgtctttttgtgattacagatctatagatcatgtgtctgatagactccctttcttcattccatactttgtgactgaatccaggcaaggcaaatcacttttaattctcatttcctcatctccaatcaggataaaattcttaggctgtagagttgatgtgagaattagagatacagctaagatagtgctgaagtcataataggcactgaggtactcattatttgatatattatagtagttaggattattatttatgaaattagaattattaatgtttcttctactccacaatgtatcaaagtagaaaagcactgatctgttggacttatctgtaaaatgagaataacaggactctgaatgaggctctttctttgagtcaatgtgtaagggttcatgtacagacctctgaaatctactgagattctttggaaactctcttgacttgtctttgaccataatttgatgttcaatgagtctgcagcaaagtgttattagtgttttatcaaatggtttaaacataatttttttttttttttttgagacggagtctcgctttgtcgccaggctgcagtgcagtggaacgatctcggctcagtgcaacctctgcctcccaggttcaagcaattctcctgcctcagcttcctgagtagctgggattacaggcacgtgtcaccacacccagctaatttttgtattttgagtagagacgaggtttcaccatgttggccaggattgtctcaatctcctgaccttgtgatcctcccgccttggcctcccaaagtgctgcgattataggcgtgagccaccgctcccagcctaaatgtaattttatttaagatacacagcatacagataaatattgaaagcaataaaaattctacaacaccagataaactttctagaagcagacttttaaagacctcattaaacatactaaacatactgtaattttacttctgcaggaggtaaaatgattgtttatctaacttggagaagccttccatttcatcttaagtaatgcatctgtaaacataataaagttccagcctgtgaagagaacatcacatcacatcacatcacatcacatagggcacatcccttttttatttttttgagactgagtctcactgtattgcccaggctggagtgcaatggcacgatctcagctcactgcaacctccacctcctgggttcaagtgattctccttccttagcttcctgagtagctgagattaccaggcctggctaatttttatatttttagtagagacggggtttcaccatgttggccaggctggtcttggactcttgaccttgtcatctggccacctcagccccccaaagtgttgggattacaggcatgagccaccgcgccaggcccacatagtgcatatcctttaatacaacacactttggttttgatggggtgggggcagaatagtgaagcatacagcatgacatcattgaggatcacaggcctgaattccctcactgcattgccctgtgacctctgtctcccttgtgaagtgacaaggtcggtctaaatctttccttcagctttaggatttcaatgattctgtaagttttctccaataagaggttggttttgcaatagaattttaaagtcagtttgccaatgtattctatagataaaactgaattagtaagtggacctgttcaaagtctctctcaacaatatgtataatttaattagcagtttaaaaagtagaccattgattattagatcagccacctgtagaaaatatgcttttgtgcattttatggtgtgatattttctttcaaaagtgttactctgtgtacattatgtcattttggcataaatattttgtttatcagagcatctcattgcctaaacatatgagacaaaagataatatgattatcttatatattttgattagatctagtgaagttaaaactaatttttaaaaacctaaatcttgggttaatttgattcaaagcagttttaaccataaatttttaaaatcttactaagaatctctcatctctttattcatactcctggatgaagctaacagatgcatattcttcaagtgcagttctgattatgcatttttttgaatgaatacatttaatggttaccttactagtttttcaataaaataacaacctcttagcctggtagtcaagtccattttatttctatcttcatttctcctcagcattaattttcattatttttaatgcatcaaatacattttctaagccaccatttcttcatctagagatttggataataacttctacattttaggtaattttgaagattaagaaaaattaaatttctgtggcctagggtgagtacttaataaaccacaattattgattgttattattatttttgagaccccatgataaaaagaatatgcttactttaacagaagaaaacatggtttcaagtcctataccttacttgttattcctcatttcaggtaggttaattaatcttcctgtgctctcatttatttatttgtaaagtggttatagtagatgattaattaataagaggatggacttaaatacttgaggagaggactctagctaaaagcaccaacaagagtttgtttcccttttcgtttgttccatgtgtagcctatattttagctataggttaatcaccatttgtttaccatgtctttcctttcctaacactaaaagttttctcaggctagtccctcaatctacaatgtgctcctatatcctatctatcaatactttacctaaggcacagctgagatatttcccttatttaaagtcttaggatttttccaccaggaaatatcttccctatcctgtgtaccctcttttatctttccaaatatacttgtatatgtcctccttatttatatatacctcttgcttcccttacttagactataatacatgaaaggcagagatgggagcatcattcttcatatctcctaaatgacctttcccaatggcttgcagataagaaacattcaataaacttaggttaactacactatgatttttctgtatactttggtctctattttaaactccttgtctcccttctaaagtaatttctacatttagggacatttcacatcaagcagaatatataacatatttttactttccattgatctacccacatatcttttcaaatcttccctgaagttgtgctatcataggtagtcacagatgacagttggaaaagacaagagtaagtgcagctcaggggaatttcaatagtagactaacatgccctacttctggcatctgagaaaaaaacagcaagaaatgagaaagacagcactgttaacttggacctggaggttagagtgggctcatgagatgtggggttctctgtccactactctaaattgttaatgctatccttaaacaggtccaagaatctatgcttgaaaattagttcccttttctagtggtggttgtagtgatgacagtgatacttgttattttcatttatgtagcaatttcacttatatatatctcattttgacatggacaggaggcagggaaatactggttagaaaagggaggttccctagaaaaggccccaccctcaagcctggaaacttgcagccctaaatgagaataagcattcctgttttcgtgcccaaatgttgccttttccaagaccactctggcctgccatgcccctattctgtgcccatataaaccccaagctccataggcagagcagcagagcagtgtagcagagaaggaaagaagagaggaagtgtctgaacacatcaagagaagttcttctgggacgacaggcaaggacatcagccacgggacggctgaactcaggggaacatcatctgtccactccatctcctttccagctccccatcccatttagagccacctccttcactcaataaaatccccacattcaccattcttcaagtttgtgtgacctgattcttcctggacactggacaagaatttgggaggcagtgggtacgggaacccaaaaaggctgtcacactgactcttcactgagccgcttaacacttaagccattcttggatagctgggctaaaagagcactgtagcactcctggacactgccatgggtctggagcccaaaagtgctcactctggctcctgcacctgctcacttgtgtgctcccactcccataaggggtttgagcatgccacatccacgtcacaagtcccacaagggggtcagggaactctcccatttcaatttgaatagcaatccagttctcagaggtagttgttattacatctatcttacctatgagaacactgtggctcagagtgatgagccaaattggccagagtgactaagacactcatccgatagaagattctagacaaaatctcttctcctgcccccaccctccaccctccatctagttcactgccctcgataggttcttttatcccttcactttttaactggcatctctgaaatgctgaggggcaaaaaatgaaagaaaagataaaatactagtgccaaaggcaaagaagaaaataccaaacaattttagtgtaaaagtaactaaacgtccttatttctattaaaaaattagcttagatcggaactatataaggcagttttctcgctgtaagagaaaattttcagttgctgtaaagggtgacacaatgcgacccaagtgatctgtagacattttaaaaacagggctgagtccaaagtgccttttcagaaaggtgttagggcttcctcacaccacctggacaaaggggtatttgcttgtaagcaacctctacaagggtatttcatacaccctgtgtcctccacaatctgaagcttaaagaaatacaaagcagagtcagcggtgccctgggatgtttctgactttacaggtctgtcgagcttgggaagatactgacatttgttatatttttcttaaagccttttccagtaataaaaagtacatcttctcttcatttctaccagatgtatttttatttttgtccataaaaaatgtccaaagtcacacagtttacaatctgaatgcagtgatttctccgtaccaatacatatcacagaataaaataaaagttgctcactggcctgaaagatgggctaccataacatctgcctacaaagtgatttgctaaacagcattggaaatgcatatcccattaaaaatgtagcattagggaattcatccagaataatgacagaagcacaaaagcaggattaattagaaccctatttctttctacttaggcctcctatgtaacattatcttcatataattttgttttgtggtctaaaataattgtttctatataaaaatgattgtaatagctttgcagttgtatgtgttcactcttaaaaaccacagacttcatacacagaattactagaaaaactaaagtattaaccaagaaaaagattcaggctggtactggacacataaatattgttttatcaggaaaaaagaggagaatttggagagatgttacaccaacatcctccagcatttcatgttttccaatggaaactgaaacagtgtttctaataacttgattcaagggttattttacaaagaaaataaaatgcaaagatatattttacatcaataatttgaattatacaaaaaagaagaaactattgatcattttcttagaatgttactataatagctatttccctagaagaggtttcaatgcagtcaaattttgatcaggcaagtgggagaaggttaagaccttagaggcctatttcaggatatcagggaaaaggaaacttgtaaaataattgtaaatcagttttctaaactgataatgtagcccttatcgataatggtttctaacttactaatattcttgattcttttgagaaaagaagttatcgatgacattaaatggatgacattacttaaatgtcatcaaatggttaatggatgacattaaaatgtgtatcaaggtgattgtggccttcttttttaaataaaaatttttcctaaagtgtgtagattgttgaggattgtctgcttactgtgaaaagctgatgcctgtccacaagggtagcttggaggtgcccatcggaggaacatggggagcggagtgtaagcctttgggagcaccgtgctatgactgcagatgctccctggctgctcagagcctagctgtgactaagccaaggctactctactacctgctttcttcatgtcttcaatggcttaggactggcttcataactagcttctggttgttgctcactgacccacacaggccttgaacctgtgatcctgaccttgcttgttctaaggcctaataactatgagtggtgtctaatactcactgattcttgaaaggtcctgtagaacccaataagcttccctcaggcacttctgcacacactctgggacatcctttcagcaagtccattccagaggagtttgacatctacaaaacagaaatccccatgctagatccttatacagcttccaaaatctcattctcacaacagcactattttgttggtatgatatccaaggtaaagaatgatgttgcaacttcctcagagtcacagtgctaaataacttcagagctagaattcaaacttaggtttttttgtttgcttttgttttgtttctttttttttgagacagagtcttgctgtgttgcccaggctggagtgcagtggcacaaccttggctcactgcaacctctgcctccctggctcaagtgctttctcttgcctcagcctcctgagtagctgggactacaggtgtgcaccaccacaactggctaatttttttttgtacttgtagtagagacaggtttcaccatgttggccaggctggtcttgaactccttgcctcaagtgatccacccacctcagcctccaaaagtgctggcattacaggcgtgagccaccacacccgacaggtcttctgatacctctattgctaatgctcctaaactgcacagcagttctgtgaactagtcacatttaaaccacctgcaaatgctctgcagtagatagacctgtcaaacaaaaaacagaggcaaccaaaacaaacactctccctaacctacttcttaaacagagacaaaaaaaaaaaaataggaaccagagaaagcaattattcccatagcatatttaaaccagataaatatttctgcttgccatcttgcaatttgaaagttggaaatggcttatggtgagttaaagagtttggaatgtgggcctatctaggaagatagcaaagtcgttaaaagtgaagtttctgaggtcaggcacctcagtttatcttctagctttgttgtttatgatctaggtggctttaggcagtttgcttaatctcctgtctctcagttgcttcccagatatacactcgagagttgaaaaataacattcttaatataattcctgttccttcatctcaccatgccacctatagactattttttaaatgcctatggactattttttaaatgcctactgtgaagacttttgtgcattgcacaactttatggcattgtttttgcattaaatgttttccatatataattataaaattatcacaatagttgttgtgacatgatttggtacttctttaatttttaataaaagcctaaaaaatgaaaatggcttgaatttccaggtcttggaaagtcctgacttaaattcatggatgcttaatttatctgtcacatgatctattaatggctatcatatagtatttttggtgaagattaaataaaataggacgtgaggaccagcacaatgtctgacatatagtgggctctcaataaatcacttctgttatttttcagaaagaaataattttttaaagctttatcgttggtcctctgattagccagcatacccccaaagttcaggaaatatatggaaagtgaaaattttataacttctggaaacctcctccatgtccaggaccttcctctgggtaaaacagaggaagatttgttttcatgaacctttctttctctttaacatttagaggtcgtgggcagagaagccttagaagacagaaatttaattcaaagactaaatgcataggaatggaatattgtagtaggtgatatattgctaaaaaacctaactttaaaaagtaattgccaacttaaaaagaagtcaggaaaagctgaggaatggttactactgtcttttctatcacagggcaccccccccccctcattttatacatgtattttcttgtaaaagttaatcaacacaaatgtaaaaactaaaataagtcaaggctctaagaagcacagataggaacatttcaaacaaagtgtacctgactagtaggcacccagccagctggcctttcctacaaaggaattttttaggagtattgtgtagtgctgtctgcaatgaacaagatagcatatcataagggcgtatcaggcatttggcaaaacttgtgctggggcccaactatgctggatacagaattctctctgttatccaggtctttatttcccacttgcaggaccatctgcagccaactccctatatcccctgaagccttcatccttcctctgaccatacatggcgcccctttggccttttgtcattttcaattattgtgaacccaggaaggtggaaactaactttaatatctgctgtaagaaaacataacaagaaatataaatctattaatttcaaaaaatcagtgattaaagccaatttattttccttggctgacattttccttcaaggatttctctgttgctcctgcctatagaagaattttagtttcccttcaaacattctactggtgccaagttaagaagttacctgaaagagaatgcataaaaatcaagttgaaatgtctcagctttgttcctttttaaaagatgaagacatagtgcattacttaggtaacactgcttctctgattcagtgggacagcttgatgagaagatatatgatactttgtacataaccgttgttttctttttgtcatcaataagttgaatcttgacttcattagagcctatccaaatgcatcattgcaacggatcatctccccacattactgtatccattatgtgtagagcaagttcatccaatttccccaacagtttatgagagaaaagaacaaattaaaaaggcctactctcttacatatcaggatgatttatgccagtgtgtcagcacacgtatttatattttctctggcccttctatttgcttaatatatgaaggaggaaagttaatattcttctgaaaaactctgttctggtctctactgatttgaacataaagttcaaaaggagatgatatcttataaagactctaagcttactgcattaaattaacaatactaatctctgtgtttcacatggtacttatgcagagcagctttacagacattaaatgaaaaaaaaatgccaaagctgtcttttatatgaaaagcaagaatagaaccttctctacatgtcccttcaagtctttttaaaagatacgcttcagctagtggtggtgaataagggggaggaaagagagccacattgaatgggttcttctcctgcttacctttcttcaacttcagacctttctaaatcccactgacctggagggaataaacagagaagaaagaagcatagcaagaagtagaaggagaaatagacaaccattcaaaaatgttttaaaaaatcatcaattaccaatctcaggaactctgggaaggaaactagacaactataacattagaaaatccagttatactccccttccagacacaccccatggagaaacttgaagaggaaagagacgaagccaacttcagcctcaaacaattttgcccatgacatcagaagatggtaggacatgaaaggggaaaactgcaggaagatctcataattctatagaccttaggaaaattccggctcatctcacattagttttccaattctccttttcccatttgtctatggagataggatatttgagcagtcccaaccacctctattcttgatttcacatgtccgttaattcaaaaaccatgtactgaaaatctctcacatgctctgctaggattaataaagacatcacacacaaacaatgtcactgctaagcttattgggctcaaggtctcacaaggtatgtgagagaggatgttggagacagagccaggaatagaaagctataacagtgatatgatataagtatgcatcaggtgctgtgagattccactcaaacagtttgtccagacatgatatttttgtaataaaatttcaagtctatgatgattgcctagctgcacagataagtctttttccagaataaaagataagccaacaatgaccacttccttattccacaaattgttagtctccatagtaaggtatggaacaaagtctggaaggaaaatattatgaagaattgcgaataatgcttctacttacttatttttgggagaattaagctaaagcttaatgaattgtattgaatgccactgaatcacattggacattgatggaagaaaaggaagttctacggtgggacaggcggtgcagcaagctgcccatcattgtacagaggttcaccttcagtactctgcagcatcttctagtttgtgtgtaccttggttaacttgatagatagatcacactatttagcatagtatctcactccaatcaatgcctgtcaataatagactggataaagaaaatgtggtacatatatataccatggaatactatgcagccataaaaaggaatgagatcatgtcctttgcagggacacggatgaagctggaagccattatcctcagcaaacaaacacaggaacagaaaaccaaacaccgcatgttctcactcataagtgggagttgaacaatgagaacacatggacacagagaggggaacgtcacaccagggcctattgggcagttgggggtgaggagagggaacttagaggatgggtcaacaggttcagcaaaccaccatggcacaggtatacctatgtaacaaacctacacgttctgcacatatatcccggttttttttagaagaaaaaaaaactgctgtattaaggcatagataagagggaaactgcatgtcatcatttactaagcacaaggtatgatgtgcttcttacatttttatgaagatatttatgtgaaaactttttcaatcattaaaagcgggtataaaactgaaattagaactaagttctgaattgacatgtatcaagattttcaaaaataattaagtacatataatcaagctgccctcactaaaattattacaaatattctattattatatacaagaagataacaatatgcaatatatacaattctaacatgttaatgagagctaaaactttctttgataatccacaaaagtattcaaatatttaattttttatcaaccttaacattttatatttcagtttctctatgttttggacacaatattttagcagagtaatacaatttacttataatttataaataaataaacacagtgagaagtatatactctctatttatatctacatacagttgaaccttaaacaatttatatttgaactgcatgggcccacttgcggattgttttcaataaaagttataccaaatgcgcctgcctctcccgtctctccttctagttcctacagctctgccactttgcctaaaaatcagcaagaccacctgcctgcttctcctcctcctcagcctactcaatgtaaagacaatcaagaggaatacttttatgataatccactttcacttaatgcatagtagacattttctctttcttatgattttccctgcctccctccctccctcccttccttccttccttccaagacagggtcacctaggctggagtgcattgttgcaaacatagcttgctgcagcctcgacctcccgagctcaggtgatcctccttcccagcctcctgtgtagctgggaccacaggtgcgtgccaacgtagagacagagtctcactttgttgcccaggctgttttcaaattcctgggcccaaacaatcctctggccttggcctcccaaagtgctaggattacaggcatgagacaccatgcccagccataattttcttaataacattttcttttctttaactaatttactgtaagaatacaacatacaatacatgtaacatataaaatacatgttaatcaactgaatatattatcagtaagccttttggtcaacagcagacaaccagtagttaagtttgggggagtcaaaagttttatgtggatttttgactgtgctgagatgggcactcctaaacccacattgtttaggagtcaactgtcttttttaaatttatagagcagataatgcaaagtatgatgacccctatcattaaagaagaaactgaggcacaaagatgcccactctaataattacataccattttctttttactccattaccaattaccataatcttaccactatttgtttgctatgcacgagcttttcatgaacataaacaccaaggctgaaagcatttggggtgaaatatatgtcccctcctctgtttgatattactgaaaaagaatctatttgggagaagatggaaattttcaaagtaaaatgggtgaactgttagcaatgataaaaattatacctataccttgggagacggaaagattttcatgacaaccttattttaaataattcttaagtttacattttctaatcttccataagcatatttatctattcaggaatatttgttagttttttatataaaatactcataaatgatagaaaaattaattatcttcgcttaagatttgctaccaaattgaaaaaggcacatatctgaaacgggatgagaaagcaacacaacaaacatgtttcctaatgatgaaatacaacgttgctattaaacttagagaataaaaacaatcgcagccataaaaaatgatgagttcatggcctttgtagggacatggatgaaattggaaatcatcattctcagtaaactatcgcaagaacaaaaaaccaaacactgcatatcctcactcataggtgggaattgaacaatgagatcacatggacacaggaaggggaatatcacactctggggactgtggtggggtcgggggaggggggagggatagcattgggagatatacctaatgctagatgacgagttagtgagtgcagcgcaccagcatggcacatgtatacatatgtaactaacctgcacaatgtgcacatgtaccctaaaacttaaagtataataaaaaaaaaatcgatcatattgaagttcagttttgtactttaacaccatctggtaaaattacagacagaatctaaaaaatatatgagtaaaccttttcttttgagatggagtcttgctctgtcgcccaggctggagtgcagtggcgcgatcttggctcactgcaagctccgcctcccgggttcaggccattctcctgcctcagcctcccgagtagctgggactacaggtgcctgcaaccacgcccggcttatttttttgtatttttagtagagacggggtttcactgtgttagccaggacggtctcgatctcctgacctcgtgatccgcccgcctcggcctcccaaagtgctgggattacaggtgtgagccaccgcgccgggctgagtaaacttttttttttttttaaattaataacttgttatgttttccactggtttaatcattctctttcttttaataaaattgaagtaaaaatgacttagtgtcgttttgtttctgctgtgtttctacaggtcatattcagagttgactgagcaccataagtgttcagccgactttgattttatttttatcgcatgcctcataaaactgatttagaaacctaaaaatgtgtcactaaaatattaaattgtgaacagtcagagcttattgagtttccaaaatctaacaagaatggctggctatgaaggcaaacaaacattcttcaaatgtagccagccacattttaaaaactattggagggatcttgaagattcagaagtgtatgattgataccatgccaaattttcagaaccagtagtctgtttttggaagacttctcctgcatggatgcctagtaatattcccatcataaagtggtttagctccattttaaaattataggggaggcctagtacatttggagaaaatttccatccattggcatttttacatttaatttccacacaggcatctttcttacattatctctgcttcacagaatcttcatcacatttcaactgtcatcagaatccagtttttctcttggctatatacttcatcattttcctcttgctgttaatgggttgatatgattgattgatggagcccctattctgagaacatgttactcagactcaggggtattaggatgctttgagctgtatgtcacagtagcacccgaaacctatgctgaagtgcccacgttggaggaaaactaaatcctaacggcttgcaagaataaatgctcattttaaatgaccagtgattccaaggaaaaaagttagatacccaaaaaattgaattcctccccagcaatgccccttcacttaaaggtctgggttcaagcaaacgcatcccactagaacccagtcctgaactttgaagtaaatgaacaaatgctcctggatgtatgaaggccccagcagtaaagctgagcacttcatagactctctcttagagcctgattgatgcttacttaacttaccaagaagggattttatgctaagatagatcatatttaagatactggttctgacgtggacacaaggaggggaacatcacacaccggggcctgtcgggaggtggagagctaggcgaggaatagcattaaaagaaacaactaatgtagatgatgggttgatgggtgcagcaaaccaccatagcacgtgtatacttatgtaacaaacctgcacattctgcacatgcaccccagaacttaaaatataataatttaaaacaaaacaaaacaaaaagatactggttctgtaacacatctgctgtgagaccatgggaaaatttcctgacttctgtcacacatctgctgtgagaccatgggaaaatttcctgacttctgtcaattttgttttccttttctgtgatgggataaacacacctattcctagaattgttacaggctggatctgatataataaccttctgatagtaatttactgatcacttgaaacaaaggttcagtgtatattaaatatgtgtttttacatatttttcattggccaagcatatttactggtaagcatgtttgttttcttctgtctagttcagataccatgaaagtatgataagattccttcaggaaggctcaggtgacgattgggataaccacatgttccaggtgtcctttgtgtaacaaattaccctcaaagttggcatattaaaacagcaaacattgatctcacagttcttgtgggtcaggactttgcgagtggcttagctgggtgcttctggcccagcattgctcatgagtttgtagtcaaggtataggctagagccacagtcatctgaaggtctgtcaggcctgggagatctgctgccatcatggctcatgcacaagactgttggcgggaggcctcactttcctgccatgcaggtttctccagagggagacagtgacatggctcctggcttatccagagttaatgatccaatagaaaaagagagagagaaaaagcaaccagaataaatactgcagcacttttttaaccccaaccttagaaatggcatagcatcatgattgccatagcctggtgtgatatgggaggagagtataggaaagggtgaataccaggaggtggggatacttgtaagcaactagcatttatataacatctctcaagttataaagtgcttttcacaaataaaacaactctaatgaagcaagaaaccagacagtcgaaattacccgcctacggccacagttatcaacagtatatactcaaaatgactcaaaagtgttattttccattacattctttatatcttcttggttctcttagttgatcaggatatactgtcttctattttgacactaagtagcttcatcttgattaagttctaatagttaaggtattaattttcatttaaaataaaatacagtgcttaattatgatggcagaaagttaatttaaataaattataacaataagaataaaatattttattttagaatggcatatttaaaaaataaaccctccactaacataatattgggctttattccaaatcccactttctagaaatttaatttacacttttctgaaaataaatataaaaaccagtggaaatgaggtgttacctgattttctatctgtaaagatgcaattataactttgaatcaactatactaccgtactatacagacttgaactagctagtggtggtgggtaatgaactatgctcctgtgttattccaagtaaacagccaactttaagcaatttttttaaaaaacagctgatttcaggataagtattaaacaacagtaccttacttcatcacttccatatgactgacttgtagtcagcgttactgaagaactaaagcttaattgtcagttaattgacacattattgtacatgtttctatatgtgatttaaaaaatcctaactcattttagatgcaaagaaaccagcacatagtctcatgccttgcagggagtgtttgaaaacaaaaatgaagataaacaatgtcttatcagaaaactcaatcttctaaatgcgttagctttaaaaatgttaaaaacagatttagagaggagaatattaatgacttgtcagcagagttaaagtgatacttatagctctttgctatatgtattgaatttgtgtctagtctaatttttttcttagagtaataaccagaaactgagctctcatgaacactgaacatggaagatcacagatcaggcaagattgtggtgtgtgtatgtgtgcacacacacccatgtacatttctaccttatatacaggatcattggtgtgggctttctctacgtctaatccaaataagctttttgcagggttaaactgatctgaatacttctttgtgaaagtaactttaaagaggtaatagtgtatggcgattatttgggcaatttagcccataatggctacaagtgggttatgttccttaattgctttgaatattacatcttgaagacagcagtgttttcacttttacaagttatcttagaaagtctgagatgcagtatacttagctcttcccaactgtaacctctctcattgtgcctttgagaaatgaagctcagattgagtgtccttacccaacaaatcaagaagtagaacttgttcccttgttcttattttgggaattttaatcctatatcataccactttcatctccagatacaacagccttggcagtatctagaggagtgtttccatacctcaatcatctgtggatcccattcatggttgaacagtacctgtattttacctagtattcctgtgtgagttttgccacacctgagtaacctttgggtcagtattttaaaaataaattagttttagtgaaataaatttattttaaatcaaatatctaattcttataaaattactgtttttcataaatggaagatgcccataaaaatctcctgtaaacaaaatctgggtttttgtctgcactcctatgcttattgcagcactacttacaatagctaagatttggaagcaacctaattgtccatcaacagatgaatggatgaagaaaatgtggtacacatacacagtggagtactatctagccattgaaaagaatgagatccagtcatttgtaacatcaataatgaaacagagatcattatgttaagtgaaataaacaaggcagagaaagacaaatattgcatattctcatttatttgtgggatctacaaatcaaatcaattgaactcatggatatagagagtagaatgtcggttaccagaggctggaagggagaagttgtgggggaggtgaggatgattaatgggtgcaaaaaataattagaaagaatgaataagacctactatttgatagcacaatagagtgattatagtcaacaataacttaatcatatatttttaaataatttaaagaatgtagctggattgtttgtaactcaaaggataaatgcttgaggggatggacaccccattctccatgatgtgcttatttcacattgcatgcctgtatcaaaatatcttatgtatcttataaatgtatacacttactatgtactcaccaatttttttattaaaagaaaagaaacaccatcaaaaaataatctgggcattttctaaaaatttcaatttaccaccttgccttgctgaaggttgagtttcatatgttttctcttatgaaaagtagagagtcacatgttttagggtgttgatacggacatatgtgtagtaacttgaggatgtccattgaggccatcaaaagcctgaaagaaaacatgaaagggactgcttccatattacatgatccaactacttttcaatgccaagtttcagtgtcatgtaaaatcagcttacttctaccaatatatgtatcatatacctggaggacttgtgatctagtctctagcagaaagagaatgggattttagcccaagaacagggtcctagcttgagcacgaccactaagctgttcagtaaatctggtctgacaacaattatatactgagaaaaccatatggagcataaagaaacgcaataaacttggtctccttaggtctcaggtttctctgaaaaatgatgggactagggtggagcgtcactgtgtccctttctagagtatgactgccttcaccagctgtttttattatcaacatttttgaaacttttacattttacttcccacagtcagagaacttctaaagccccaaaggactgccacctcacgtttaacaaagataaattagaaaatatgaaatgaatgctatcatcttcctaacatgataacctcaatataaacttaagagtgacatttccaaagtcaaatcataatctggataagttgtcctcaagtcttgtcaaaagacgactcttcccttggaaatcctagtgaaggtacccaattgcctctccattcttgttaaagaatgattatttttagatgaacaggagatcctactttcctcccattgcagcagagatatttcacactttttcaactagtccaaattcaaaatggttattccttaaagattctgtcaccagaaatatactcattcaaggaactttgtactctgtcatatgtgaataaatcagcttcatgttccaggtctattttatgctatgtaacttttttgtagacaacattaatgagattttagtctatcctgttattcctatattggagtgttttgtgttttgacttacttatcatagcttgtatttacaaagatgggactcagtaaagttggaaaatatatgttatgaagcaaatttatataactggacataacccatgaaatactgagtatgtctttaaatatatcagataaaattacataattaatactgcaatcacattttatgaaataaaggttttttaaaggaaagagcaaaaatatctctaagagttataactgagattgtctttttcatccatcaatcttctaaagtatatgttccagaaaaaaaaaaaaaacatggtgcactaaatcttagcaaagataatggatttctacagaagtaccttaagatcagagatatagattatgaaagcagtccattaaaaaaacagaaatgccaagttagacattttggcttttacaaataaatgtgaattacataagttaaaatccagattctgagtccctcagaccacttagggattactgacagtcttcttttgagttcttattttcaatattacacatccaaaggcttaacttgtaaaaggcatctggcctgattcacttgaagaattctattttaattcaaagggtatataattagaatactagtattctagcacttcaagatatttttaaagttgtttgaaaactgctatattatcacagaaggttcctcactggcacagaaaatggaaaagttgctcaatgtgttcaggatgctcttgaagctacctctttattgctttcctctcttcatttccaggccatcagtacctcttgaatctaccatcactgccagttccctgcagccatctgctgccaatagggtttcctaaagcattgctgcaatggtggagcctctccactcaaaggcctgtagggcatcctgttccactggtatgcatgccaatgccatgacccctccctgatccatatttccaatcatttctttcactctgccatatcagcaatgctttctaactcccactgcagcctccactgctaccaccctagtcacagccaccactcttcccactgttggtattcttttgttttttgagatggagtctcactctgtcacccaggctggagtgcagcggcacgatgttggctcactgcaacctcctcctcctgagttcaagtgattcttgtgtctcagcttcccaagaagctgggactacagccatgagtcaccacacctggctaattattttgtatttttagtagagacggggtttcgccatgttgaccagcctggtcttgaactcctgacctcaggtgatctgcctgcctcggcgtcccaaagtgctgggactacaggcgtgagccactgcgcctggccccactgtttctattcttgaccctccatagtatgggccagagaacttactctgtgaagggtcagatggtaagtattgcaggctttgtgggccagacagtttctgttacaactactcaacactaccattataatgcaaaagaagccataggcaatatatacatgaatgagcatggccatgtttcatgcaaactttatcattagacattacatttcagttttatataatttccaagtgtcataaaatcttcttttgattttttttttttttttttggtttccatcatttaacaatgcagaggcaattcttagttaatggaccatgcaaaaaaacagccaatagactggatatagcccacagccagtagtttgctgacctctgctctacaacttaattgtaactgctgtgtttagaatgctgcagtggttccccattccactcacgacatgtgcttaggtcctcaccatggcctaaaaggcctcatataatctgtttccctttgcctttcttctgtcttctccatttactccctggttttcctctgtttcagcaaactgacatgctttctgcttcttgaacacatggaacacagcctgccttgtgacttctgcactggctggcctgtctgcctgaaatttgtgttcccagatatttctatgtttctcttgcttgcttcaagattttgaccaaatgccattctctgatagtctatcttgactactctatttaaatttcaaccacactgttatggacggaattgtgcctccccatcccaaacttgtttgttgaagtcctaactcccagtacctcggaacgtgactgtacttagagataagatctttaaaggagtgattcagttaaaatgaggcctctaggatgggccctaatccaatctgaccaatttccttataagaagagaaaatttaggcacacagggagataccaggagcacacaagcacacagcatagatggcatgaagacatagtgacaaggtggccatctgcaagccaaggagaaaggactcagaaaaaaatccaacctgctcataccctgactttggacttctagcctcaattgctgtgagaaaacaaatttctgttgtttaggctacgtagtctgtgatattttatagtgatggccccgttaaacaaatgcacactctaacctccacagtcttcccaaaccgacttatcctattgtatatttacccagagtatttatcatctactgacatgcattttaatttactggcttagtatgtgtattatctgactccccactacatgaggctaagatcttttgtttatggatgtatccaaagtttgcagaagaggacctagcaaaggataggtacttaatgaatacctgttggataattgaatcctagcaatgcattcatctcttatatcccctgcctttgtttcttggctcttcctgaggtccaatccccaactccacacccatggccagtgaaacccacctcaaatattaacaatgctaagaatgtatctcttgccaccaacactctgtgctctttctctttggagtctagtaatacactatctgtttttctcttgtggtgcttaatacattcaagcctgtattgaattttctatatatacgcatatctcagagatattgcaggttccattatagaacacagcaataaagtgaatatcacattaaagtgagtcatacaaatttcttggcttcccagtgcacgtaaaagttttgtttacactgtactgtagtctatgaagtgtgttattgcattatgtctaaaaaatggacataccttaaattaaaatactctattgctaaaaaatgctaactatcatctgagccttcagtgagaagtaattttttgctcatggagggtcttgcctctatgctgacaaatgctgactgatcaggacggtggctgctgaagtttgaggtgtctagtgtaattcttaaataagacaacaatgaagtttgtcatattgattgactctttcatcaaggacttaactgaagcatctgatgctgtttgataacattttacccacaagataacttttttcaaaattaaagtcaatcctctcaaacactactgctgtttattgactaagtttatgtaacagtctaaattctttgttgtcattccagcattgttcacagcatcttcatgaggagtagactcctttcaagaaaccactttctttactcacccataagaagcaactcttcatccatttaagtttgttctttagatggcagcaattcagtcacatctccatgatccatttctaatcctcgttttcttgctatttccatcacatctccagcaacttcctccactgaaggcttgaacctctcaaagtcacccatgaatgttagaatgaacttctcccaaatgttgatgttttgacttcctgtcatgaatcatgaatgttcttaatggcatctagaatggtgaaacctttccagaaggttttcaatttacttttcccagatcatcagaggaatcactatctatgacagttatagccttatgaaaagtgcttcttcagtaataagacttggaagtcaaaattactgtttgatccatgggctgcagaatggatgttgtgttagcaggcatgaaaataacattaatctctttgtctatctccatcagagctcttgaatgactaggcgcattgtcaatgagcagtaacattttgaaagtaatcattttttctaagcagtaggtgtcaacactgggcttaaaatatacagtaaaccatgatataaacagacatgatgtcatccaggtttggttgttccattattgagcagagacagagtagatttagcataattattaagggccctgggatttttacaatgataaagaagcatttgctgcaacttaaagtcataagctgcattagtccctaaaaagagagtcagtctcccctttgaagctttggagccaggcattgaattcttctctctacttataaatgtcctagatggcatcttcttccaatataaatctttttctttatttttattttttgatacagggtcttactttgtcacccaggtggggtgcagtggcatgatcatagctccctgcagccttgatctccctagctcatgcaaccctcccacctcagcctcctaaggagctgggactacgtacagtctcgagtagctgggacaacgtgcgtgcaccaccatgccaggctaattttaattttttttttttttttaaagacaaggcctcactatgttgatcaggctggtctcaaattcctgggctcaagtattcctcctgccttggcctcccaaagtgttgggattacaggcatgagccaccgtgcccagccaggggcttcttcatctacactgaaaatttggttttcagaggaacaacatttatcaatgatcttagctggatcttctgaataagctgctgcggcttctacatcggcacttgctctttaaccttgcacttttgtggtatggatatggcttcttcatgaaccaacctctgctagcttcaaactttcttctgcagcttccctatttctctcagcattcatagaattgaagagagttagagcctgtattagaccattcttgcattgctgtaaagaaatacctgagactggataaattacaaagaaaaaaggtttcattggctcaccgttctgcaggctgtacaggaagcacagcagcatctgcttctggggaggcctcagaaagcttccactcatggcagaaggcaaagggagcagacacatgacagagcaaaagcagaagtaagagagagtgagggaggggaatgccacacttttttttttatttttatttatttattttttttgagacagagcctcactctttcacccaggctgaagtgtagtggtacggccttggctcatcacaacctctgcctcttgggttcaagtgattcacctacctcagcttactgagtgtctgggattataggcatgcactatcatgcccagctaattttttttgtaattttagtagagacagggtttcaccatgttagccaggctggtctcgaactcctgacctcaagtgattatgtccatgtcagccttccaaagcgctgagattacctgcgtgagccaccacgcccagccaatgccatacactttcaaatgaccagctattgcaaaaacccacacactattgtgagaacagtaccaaggggatggtgctaacccattcctgagaaatccaccccataatccaattttctcccacctccaacactggggattgtaactcgacataagatttgggcagggacacatatccaaactgtatcagagacttcctctggattaggctttggcttaagggggagttgtggcaggtttgatcttttacccggaccactaaaacattctttatatcagcaataaagctgtttcactttcttactattcatgtcttcactagaatagcaatattaatttcctactagaacttttcctttgctgtgacaacttaactaacagtttgacatgagatttcagctattttggctttggacatgccctcctcattaagcttgattatttctagcttttgatttaaaagtgagagatgtgtgactcttcctttcccttgaacacttagaggccattaaaaagttattaattgaactaattgtaatactgttgtatctcaggaaatagggaggcccaaggagaagaaaagacatggggaatagctggtcagtgtagcagtcagaacacacacaacatttattgattacgttcactgtctcatataggtatggttggtggcactccaaaacacttacgatagtaacctcaaagatcatcataaaagatataatgataatgaaaaactatgaaatattgcaacgatcataatgtgactcagaaacatgaagtgaacatgtgtttttggaagaatggcgctgatagtattgcaaaaggcagggttgccatgaaacttcaatttgtaaaaaatgcagtatctgagaagtgcaataaagcaaagaacaatacgatgaggcatgcctgtatgttttatattctccactaaatgtcaagctcctttatggtgcagctattgcctcatgcatcttaaaatcccttaccataccttctgaatgtgccacacatattaaagacacaacagaccttagctgaaattaggaaaattattacaataaaaacacttgttactgaacaattacacattgtgtcaggctctattttaagtcttcatgtcacttgcctttactaacaaaaatctcatgaaggtcggactatcattatctcaaatttattgataaggtcactgaacctaacataagtaacttgcccgagatcatacgactaatgattggtgaagccagatttttttttttttttttttttttttttttttttttttttgagacagagtctcactctgtcacccagggctggagtgcagtggcatggtctcagctcactgcaagctccacctcccgggttcacgccattctcctgcctcagcctcccaaatagctgggactacaggcgcccgccaccacgcctggctaattttttgtatcttttagtagagatgaggtggtgaagccagattttaagcacagacctattgttctacagatatcagatatcaggatctatagtatactgtcttgccagttaaaaaacaatgcttactttaaagaagatcatgtcgtttgtgggaacacagatgaagctggaggtcattatccttagcaaactaacgcaggaacagaaaaccaaatacctgtggtgcatacacattgtcccagttactcgagactgtacgtgttctcacttctaagtgggagctaaatgataagaattcatgaacacgaagaggggaacaacagatactggggcctgcttgagggaggagggtgggaggagggagaggagcagaaaaaataactattgggtactaggtttactatctggctgctgaaattccataaaacaaaccctagtgacactagtttacttatataacacatgtacctccaaacctaaaataaaagttaaaaaaaataaatctgtaaagcacataaaaaatgcttactttaaaataaaaatactgctatcatgttaaatgaaataaaaggaagcagcatgtacctgaattcttatgcgttttagaagctggaatggactgatttcacatttcccatgactacttttcttattctaaattctgagagggtagtctttgtgcattggtcaaattgatatacctactgaaattttaaaattcatatttcataataaaattcttctctacatcttatttcactggtaatacttgaagatttaaaacataaaataataaaatgtattaaatatggttgtctttcctaaaactaggactttaacatctacgcaaatctgttatgcttttataatatttcataaataatttaaagaatgagtaggttgttaatattggcttgtgaagtaactaatttctacatgttattgtagtttaaaaatttttttactatactttatatcctaggaaaaagccaagattaatagttaatcttatttttggtgaaaaaaacaaactttttaaaattattattatactttaagttctagggtacatgtgcacaacgtgcaggtttgttacatatgtatacatgtgccatgttggtgtgctgcacccattaactcgtcatttacattaggtatatctgctaatgctatccctcccctctcccccgaccccatgacaggccccagtgtgtgatgttccccaccctgtgtccactatgttctcactcataggtgggaattgaacaataaaaacaaacttaattacaaattttttgaaaattaaggagtttagactcaaaaagtgttagcaagaatacatattgcacatatttgtataatatacaagtcatctgacatttttgggtaggaaatatcttttggtaggagagtaataaagcataattaagtaaaaccctttaagtatattaatgtataattttatcatttatgaaggaagtctttgagtcatatgttctacctaattttgaacattttaaaatcaatagaaagtgaacacattttaacattttctaaggaatttaaaataattgcataatgttttacataatacactacaccgatttataagtatctgaaacaggacttagtgctgtttgaatgagtactgattccagccactgtccttacaaatgctggcttgtaaaagtactcagcagaaccttgaattgggatcactttatttttccaatgaggaaactgatatcatggggggaatataaacttgtccaaggtcacctgctaagacgtgatggtgcaaagataaaagttcaagtcattttctttgccaggtctaagtgtttctaccccaccaagccaccacctgaggcacttgtcacaatgtaaggttgtgagagcaatgtgcttgtggaatgggagagtaataatcagtacgtggaccaattagctgttatgaccttagtaaaatcacttgaataactcaggtccagttgtctcttccgaaaataaagaaaggagaccaaatgatttttaagatccattgagatgtaacgtgtctatgatccaagaatatattctgacacaaaaaattcgtttatatgagtgacatgataaacacaatgttgtctatattgttgccattgtgttaaggacttgtaccactttgagtgcaaacaagtttctcaaccttctaagttcagggattgtgcttttacttgaagataggctaggagggcatcattggaaggaacatttgcatgtatttgggaacatacccagcacttggctgtatagtttcccttgggggaattcagtagacacagcataaaactgatctttaaagttctaaaagctttttatagaactggcttcctagttctttaaagccttttgacttttgtttggctcagggaattacaagatgattaggaaattctttttgtatctcccatcataaaacaggctctatgtatcttaacatgttatagaacaggaatgtgactgatttggtaggcattaagtctcttatcctaatctggtggtcttgaaaaataaaaatcttcccattgtagaggtaataatattgagctcggaagatttactactttctccaggagaagaaaactgcagctagagaacagatcaacttaaagcctggtaatactttactcaaagcatggtaatatgtttttttgtgtgtgtaaaatctctaaaatgatagtacagccaaggcggtatctgtttccagtaattttaccgtatttgaagatgggaagaacctataaatttctaatattaatttattagtttatcttatagagatataactatgtattttttattttaaaaacattaaaattcaactattatacatatactatgttccccgtagaaaaatgagaaaatacaaatacattgacatttatacataaatcaaccataagatgtatgactttttaaataaatgagcaaatatacaggacctaccccatttaaaaatgtgtacagttagagagaattcacacttccaaagctctcaatcatctataaccattttttatgattggaagaagtaccaggtagagatagaacagaaccataacacagattagaatgagcagctgaagtagccaagatcagaagtgattaggtcaaatggtatttctagtatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcgtttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagcgcaccagcatggcacatgtatacatatgtaactaacctgcacaatgtgcacatataccctaaaacttaaagtataaaaaaaaaaaaaaaagaagtgattaggaagtcacaattctaccaacctgggaaaagatacgcaaagaaataggcaggagatggtgtagctttgtccccttaaaagcactggtgttgttcaattttgtagcacttccaatgactatgtaatgaacattgactgtgcaccagtatggtctaggcactggattacgataataaacaacaaaaaacccataattattttaaaaagtttatattccacttttacagacatttgtaaatattctatgttattttaggtagtggtaatttttatggagaaaactacaatgcctcccagcttgtgtgggacagtttggatttgtgcctgttttcctgctgtgatgattaagattgcctctttttactctcaaaaatgtcctagttttggtgaccctctctgtaaaagaaatttcaaaacaatgataatatgaaaatatgtatgggaggggttcttttggactggatgatcaggaaatgtctcactaggtgatatctgagctgagaattaaagtaatcacacagctcttaagggtgaatttgaatttgagaggggaaaactgtgtagtcaaacaaagacgtagtttagattctgacaaacctgattttatacctcagccccagcacaccctaggtttggtactttgggcttggctccctgtgagatactcaatagtataccttaagtctaataatgtgattcagaaatgaacacattaaattacatgggcaaagaaacttatatttatttatgatatcctctcacaataccataaagaaataatctatattttaaagcaactactgtgcagtacacactgtgtttgggtacagctggttaattaagtattaccggttgagtatccctaatccaaaaatatgaaatccaaactgctccaaaatctgagcctttctgaatgctcaatggacactcaaagaaaatgctcagtggagcactttggatttcagattttcaaattaggaatgctgaaccagtatatattctgcaaatattccacaatccagaagagtccaaaaaccaaaacactgctgatccaagcatttcaatgatgagatactgaaccaggttttctgtcttttagaagatactgatctacctgagataaaacttgaacacctgaatctgttcaatatacagggttgactagtaattaaatgctgaacaatatgggacagacaacttgtactatcagagctcaaaaagaaaataaatcaatatacattacagaatgaagcagggttccaaggaaagaaaataggatctgaacaggtgtttaattgataaaatgcaatatttcctacctgaccactcaaaaagccatggaaatttgctccaggcagacaacaggaccctctgttgggcttggccagtggtttctgcagcaatcgggttgtctggaccatttagctttttagcaaaacttcctgttcctacaaataatcccactaatcctctctctccccagctgcttccttgcctttcctgcttggctcccctctcataagcctctttctttctaattttttcagaggaacatattttacagtcccgttgcttcacctaccttgcccattgtccttgcctaaaattgtccttgactgaaatagtaagagatagttttcctctgctttttgaaatcttagcatatgttggttggttgagttaactgcttcatatttatttgctgtactggcaggttgacagggcaactgggaatcatgaagaaatagttcagcagaaccacgagactcagctcttaacaagcacttaataaatgttggttgaatgaataaatggctattgtagttattgaaaactaatacaattaaaggcaagtgagtttaaaaatcacagtcatttatataggtacctttctatttattcctaattaccaggaagcataataatgattaggtatttcaattatttttagtgaaaatttaatttgaataaaactaatagaacatcctatagataacagatcagtaatagcgacaaatttgttaaacgtgtgccagcaacagaaataattgtacaaagatccccattttacagatgcgatgacccagcttagaggggtcatctaattggtcttcccaattgtgaggttaggaattaaaagctggaattccaacacagctctatgctgtgctgttgcctctcagaaagatggctgggggttgagcagagagaatagctctcctggaacacattttcagaatataaactttttcagttatgatgtaatatatttatattattgtcattaagactatgatgaaaagacattagaggaagcaaaacaaagcctgatagttcagatatgagataagtaaagaagggtgtcaaatgacgaaatgctttttatgatgatatagaacgatgaaatgctcccttatgccaaaccttggcacagtacttctatgcccaccctggccactgattcagtcctactctcatatttgttcttcctgaagttggaaaataatgattcactggccatcctcagacattattacatgttgatctactgcagggttttattcaccctcctttaaaaacataaagtgaacattagccccaaataaagaacaccttgagacatcctgatgtcactgctatatctctattaggaaggagaaataaataacgttaagcatagagccatattttgtagggacttgctaaaaactgatttgttggtaaaactagtttatattgcaaatatacatatatatgtatatatatacatatattatatatatattttatattatatatatatatatacacacacacatacgtaaatatacacatcaacgatgatctctgtcatggtcagttggacttttcttccacagttaagggaagctcctcagatcttaccttcccaagcccacaaatgtatcccaatactggaaaaacagtgttggaaagaaaataaacttcatccaagaaaagatgttgatatggtttggatgttttgtcccctccaaatctcatgttgaaatgtgatcccagtgttggaggtggtggctagtgggagttgtttggatcatggggctagatccctcatgaatggcttggtgccctccccagtgtaatgagttactgacagatctgattgttaaaaagaatctgggacctcctctcctcttgcttcctgtcttgccatgtgacacatctgctcgcctttcactttccaccatgattgtaagcttcctgaggcctcaccagaagccaagaagatactggtgcaatacttgtacagcctgcagaaccgtatgtcaagtaaatattttttctttataaattacccagcctcaggtattcctttacagcaatgcaaaacagagtaacacagccatcaatgtgcctaacaaacacaaaccatagccgtatctcactgagttgtaataacatcttcccataataacaaacatcacattattttcaaatatcatttaatttagctgattataatgacattctctcagaatacagagtcagtttgtttgaatgtataggtttactttacttctggaatgtaaaaaaacatacagagaaatatttgagagaagttttactgtcaaagtaaaagataaacaatgatagcaaacgatgtggtagaatgataggaacctctgcatgacccacagatatgattagcttgctcatgccactttcaatatcttttgaggggaagcaacatgaccactgtgagtaattttaaataaaaaagcccagtcagtggtaataccagtggtgagtgaatataaaataatcaatactgctatgaacatatttctcctgcttagagtagctttcccgcaggttcctaggatggggtcagacaatggaagcagtagcagaaactctgaaagtaggaggaaaatgagaccagcatttttttcttccctgagctttcttcctaacaggcctctgtgggtaggctatattcctgtactcaaggccaccactctgtctggaagctttctagacacaggtttcctctccaggctctggaaatggttcctatctcttgcctcttcaatagtttactgttaccagctggagcatacacattaccccttattgctccaatatagagtcactttatcaaattcttttctggagtgtaagatctcattcctgccagaaacagaactgatacagatcacaatcgatgtataatatcctcggtagtctttgtcttgtattgtgaaacttaaacgtttctttaagtacttaaacgaggcactgatgtgtaagtgctgaagtttctggtaagaaagctctgattacctttagcaagaggggcaaacgcagctctttttttttttttttttttttttcttgagacagagtctcaccctgttgcccaggctggagtgcaatggcgccatcttggccactgcaacctccgcttccagaattcaagtgattctcctgcttcagcctcctgagtagctgggactacaggcacccgccaccatgcgcagctaacttcttgtatctttagtagagatggggtttcaccacattggtcaggctagcctcaaactcctgacctggtgatccacccacctcagcctcccaaagtgccgggattacaggcgtgatccaccgcaccaggccaaatgcaactctttctatgaacatgagctcctccctttagacctcgtgaaacatgttgattaatttagccaaccagtcaacaagtgagttttaagagtttaccacgtctaagactgtgagatcagaccacttactactttaaagttatgacaatgataaaaacagtcttctttgggaaagaggctttaaccctgcaagcttacctactatgctaattataggaaaaagaacataatttgcaatgtaataaaacattaacatgcaaatttctttctgaaattaaagaaggcaaccagtaatctgtatatataagtgttttgtttgtttaaatcagagatcatgtaatcagatttggcagaaatggcagattataagaagattaagcaagaccatgaattccccacaaacgtccctttaatcctgattataaagttaaacaggacaaaataattatcctgataaagttgaaaatgtaaactctgttgggaaaagtaacacagtgccataaattcattggcagtcaagtgtaaacatcatttttctttgctttcttttagcttcagaataggtttcaatggaagaaagagcaaaagaaaacagtgtaacatggtggtattttatatgcatttgaataataaaaattttacatgatgctttaagaaatataatcttgttttatcagcaaaatttgaaagaatagattaaaaagttgaaaaaaaataaatcagcaatagcataatttcagagcatgcgggccaagagaatataaactgtgtatttgactgccacatgtcagggccacttgaactgggaaatagaaaatcctgtcatttttttttttttttttttttttgccaagattcaacttgaattttgctagtgtttatttatgtgaggtctttaggggtacttcctttgtgtgagatgtgtctgccctatgtgtaaatgtggctgggctgggggatgagagagtacataggagagagaggttggaaatatgattctgtgttctatcatctccagggagaaagaagagaacagaaaatggaagggcacacagccagaaacaaactttgttcaagtctccgattttgcttaggatcacctcttccagacagagtggtggccttgagtacaggaatatagcctacccacagaggcctgttaggaagaaagctcagggaagaaaaaaatgctggtctcattttcctcctactttcagagtttctgcttctcttcagacttcaaaaatgtagtataaaaaatatttaaaatatttaaggctgggcacggtggctcatgcctataatcccagcactttgggaggctgaggtgggtggatcacttgaggtcaggagttcaagaccagcctggccaacatggcgaaacctcgtctctagtaaaaatacaaaaattagcagagcttggtggagagcgcctgtaatcccagctactcgggaggctgaggcagagagaattgattaaaacccaggaggtggaggttgcagtgagctgagatcgcaccactgcactccagcctgggtgatagagcaagactccgtctcaaaaataaataaataaataaataagtctttatatgactagcctgtggtggcttgacccacaataacttcagtgatgtcaattttaaggctggaaaccactcaaagaaaacttgtgaaacaaatggacaaatgtgcatcatctctccctctcatccgttaatctaaagctctctacttgatggaatgatgaattcttacctcctgcttttaataatataatttcacaaaatttgaaatactttaacacactagttaaacaattcagtgtttcacagaatttttgggtttaaattgcttttgcttcccttaggtggagaattgaacttggacatgcctataactttcagacctgaagcctgaaacagagctccaggcaatattcacctcacacgtatatttggggaattcttgataatggaaaaatgtgttcaggtcttgatttttcaagaaaacaatgtacagaatattgaaaaatgtcaaaacaaccttcaaataagtaccctaaaacatgacaatattaaatttcacacataaagaagaaacagttcaaaacatgatatctgcaataacattcatccttctcaatggggcagcattcatatgatagggtgttgtatgggttcctatcatacacaaatagaagtgtcgtattcttggagcaatcctaagacctatctccatttatttaggtgtacaagaatatattgggtagcatgagccccatctagaattgaatatgatatggtacatcaagaggcagatctcaagctgagaagaaaataggaaaattgatcctacagtgaactgaggccattaacttgtaatatttgcatatggatttctgtgatttgctatacataacaaataaacttttaaaaagcatatgtttttatgataaatacagacattatatatgtttgtaaaatacactctttgagaagtgatctgccatgataaaaaatatgtaggaagtttcagggaaaatagatgtatcttattttagctggacaaatctttacttttgaatctgtactctctaaaaaaattattttagaaatcaaattaaatttttaatttgtaagcaatcctagacactgccacaacttacatgaaaagctctcacaaaaggaaattgcttttctgtaacttgtgataacactaataagacaaattgaaggaaagtttgtatccacaaaaatttctttgcacttccaatattctatgtttgtataaatggcccattgtggtatcaaatgagaagcagctgccaaaaataaaattatatattttggaattaacttgttttcaaatgtaaaacaaaatcaccgtttcctcagataacacgattgaccaaaaaaaaaaaaaaaataaaaataaataaataaataaagggctttttggtaaaaagaaaaaaaatcacccaagacatgttcgtgttgttttaaatttttgataactacaaagatacatgctgattgctcaggatacaattagcagctgcctgcatatccaaccttaaaggaaattttttaagctagttcaactctgtttcctacttcttcattaattactagctaagggacttgaaagtgtcctaatgaattttacattagactctgtaatatgaatggtgtatattatcacagcatctagtaaatgcataaattggcttttccaagtcgcattttgagtagttgtaaagattctggctggatatcacaaaatttagtattagagactgagccgaaaagaatttttacaagaaacaggttgctgcaatcacatttctcaggtcataaatctatgttactactttatgataatctgtcggtccttgttctcaaagttcaaagatgctgtgcttcttctttttttttttcctcctgtggttcaaaaagaagaaagcaatcccacttacagtgatttccaaatacgcattgaataaagcttaaaatactactgctataccagctttccataatttccatattataaagtaccatccagtgataaagtaccaaccacagtgttttggatttaatacttatggtttacagtttcccaaccacttaccattttcgtaaaattctttgaaatcaaaagtttaagaaaactattcaacaaacagaatgagctagacaggcagaaaactgtacctaaatccagtcagaaacagacagaaccttaggattgccctatcagagaggaaaggacagacaaccatggaaacctcatggaaagctttcttttataaaatatttctctaatttcatagcaaggtaaaagatcacctcttgctcattttcaaatgtgacatgataccataaatggcacatcatccttacttgaatgtttaaagctaatatgcaggtaatgtcaaagtcatagtgatgggactaaacatttgtaatctaaaggtgaagactgcgtgagaaacaccacagagctccgagttggcaaaagtcagatacagactctcaatgattattccttaaagaatatccaaagtcaccacaattcacattacctaaagattaaaatgcggatattaacaggaaattaacattaggatgttaacaatcctcttaatatctattaatatttgatgatgctctctaaaatcatttgattgtcagttactctcttaaaatggttttcccttattacactaacataattgtatatgcagtttagttaattatcgccaagactttactttcttaggtaaaatgttgctcaaattcatctctcagctttatatcagcacaagatcacctcttgctcattgtcaaatgtgacacgatatcataaatggcacatcatccttacatcatccttacttacagtgtgtgagtttctttactctttttttctctttatttagattaaagaaaacaaatataggtcagtatttgaaaaataaagctcacaacagttctttatgaccagaatcaaagtgtgtgtcctgttaaccaagatttgtctctcagaagtttgatgatctgttaaaaaatatatatattatcagtgtcaagtattttagtcccacctgtcactaatttaatgacggcattgcctaggaatttcatgagcaacaaaactgttgatttagcctcataattttggaacatattaaaaatattttcttgctatcaacacttagatttaaatagaatttctatttcaatcatgaaaatttttaaacattgaaatccactgcaatgaaacaaatatgaaacctcacatggacattttactcttcagctgttttcatattttgctcacattttgcaaggaacccagagatccaaaagaaatatccttaactctttcccggccaagccctatgatcaaacacatgggaaataatctatggattacaataatcaaacagttctagagaatttctaaatatctgcaggaagaaaatctgtgtgcttttcaagtaaactgcagcaatcaggaaagaagagaaaaaccccttgcacaatcatgtatttaaaaaaaaaatctttctactctgcagatactgtttcctgaaatttaccaagaacactgccttgaagagataaaaaaaatacatccatagaagtcagttctacccccaaaagagctgcactgcacacatttttagaaacataaatctcagcaaatacagttgcattttattgacaacattaaaaataatcacaacaaagaaatagcctttcctattccatttcaacttcattaccatgctctactagcctctactaaaaaaaaaaaaaaaaaaaaaaaaagtcattacctgtatgaagagaacctgttaatagtctgagaaggtactgggcaaatttcagtatttcacgtttacaccgctttctacagccactcatcttaagcaacaaggtattcctctgaggagagccagaagtctttgccaataataataataataataataaaaagagagtctctgaggagaaacttctgtctcagtttatgcacaggctgccttacaactcctgtggaattagctgttagcgcctcaatcagaaattcctttaaaatgctagagaagccagatacagctacaacagtaacagggaggtgagaaaacacggcttctcagtgtggtgaccaagttcttctgt
